United States Patent
Kwong et al.

(10) Patent No.: US 9,695,230 B2
(45) Date of Patent: Jul. 4, 2017

(54) BROADLY NEUTRALIZING HIV-1 VRC07 ANTIBODIES THAT BIND TO THE CD4-BINDING SITE OF THE ENVELOPE PROTEIN

(71) Applicant: The United States of America, as represented by the Secretary, Department of Health and Human Services, Washington, DC (US)

(72) Inventors: Peter D. Kwong, Washington, DC (US); Gary J. Nabel, Cambridge, MA (US); Rebecca S. Rudicell, Silver Springs, MD (US); John Mascola, Rockville, MD (US); Mark Connors, Bethesda, MD (US); Ivelin Georgiev, Gaithersburg, MD (US); Jiang Zhu, Ashburn, VA (US); Young Do Kwon, Rockville, MD (US); Tongqing Zhou, Boyds, MD (US); Yongping Yang, Potomac, MD (US); Baoshan Zhang, Bethesda, MD (US); Gwo-Yu Chuang, Rockville, MD (US); Xueling Wu, Potomac, MD (US); Zhi-yong Yang, Potomac, MD (US); Wei Shi, Rockville, MD (US)

(73) Assignee: The United States of America, as represented by the Secretary, Department of Health and Human Services, Bethesda, MD (US)

( * ) Notice: Subject to any disclaimer, the term of this patent is extended or adjusted under 35 U.S.C. 154(b) by 65 days.

(21) Appl. No.: 14/363,740

(22) PCT Filed: Dec. 10, 2012

(86) PCT No.: PCT/US2012/068827
§ 371 (c)(1),
(2) Date: Jun. 6, 2014

(87) PCT Pub. No.: WO2013/086533
PCT Pub. Date: Jun. 13, 2013

(65) Prior Publication Data
US 2014/0322163 A1 Oct. 30, 2014

Related U.S. Application Data

(60) Provisional application No. 61/698,452, filed on Sep. 7, 2012, provisional application No. 61/613,431, filed on Mar. 20, 2012, provisional application No. 61/568,520, filed on Dec. 8, 2011.

(51) Int. Cl.
| | | |
|---|---|---|
| C07K 16/10 | (2006.01) |
| G01N 33/569 | (2006.01) |
| A61K 39/42 | (2006.01) |
| A61K 45/06 | (2006.01) |

(52) U.S. Cl.
CPC .......... *C07K 16/1063* (2013.01); *A61K 39/42* (2013.01); *A61K 45/06* (2013.01); *G01N 33/56983* (2013.01); *G01N 33/56988* (2013.01); *C07K 2317/21* (2013.01); *C07K 2317/41* (2013.01); *C07K 2317/565* (2013.01); *C07K 2317/567* (2013.01); *C07K 2317/72* (2013.01); *C07K 2317/76* (2013.01); *C07K 2317/92* (2013.01)

(58) Field of Classification Search
CPC ...................... C07K 16/1063; G01N 33/56988
See application file for complete search history.

(56) References Cited

U.S. PATENT DOCUMENTS

| 6,117,655 A | 9/2000 | Capon et al. |
|---|---|---|
| 2005/0220817 A1 | 10/2005 | Sodroski et al. |
| 2008/0286290 A1 | 11/2008 | Furusako et al. |
| 2009/0232831 A1 | 9/2009 | Wong et al. |
| 2010/0093979 A1 | 4/2010 | Lazar |
| 2011/0044994 A1 | 2/2011 | Chan-Hui et al. |
| 2011/0044995 A1 | 2/2011 | Matsushita et al. |
| 2012/0288502 A1 | 11/2012 | Diskin et al. |

FOREIGN PATENT DOCUMENTS

| WO | WO 99/01475 | 1/1999 |
|---|---|---|
| WO | WO 99/24065 | 5/1999 |
| WO | WO 2005/034992 | 4/2005 |
| WO | WO/2006/074071 | 7/2006 |
| WO | WO 2006/091455 | 8/2006 |
| WO | WO 2007/030518 | 3/2007 |
| WO | WO 2007/030637 | 3/2007 |

(Continued)

OTHER PUBLICATIONS

Xiang, J. et al., 1991, Modification in framework region I results in a decreased affinity of chimeric anti-Tag72 antibody, Mol. Immunol. 28(1/2):141-148.*
Hornbeck, P., et al., 1991, Enzyme-linked immunosorbent assays, in Curr. Prot. Mol. Biol. 11.2.1-11.2.22.*
Bonifacino, J. S., et al., 2016, Immunopreciptation, in Curr. Prot. Cell Biol. 7.2.1-7.2.24.*
Supplementary European Search Report issued by the European Patent Office on Aug. 6, 2015 in related EPC application 12855597.6 (7 pages).
Rudicell, et al. "Enhanced potency of a broadly neutralizing HIV-1 antibody in vitro improves protection against lentiviral infection in vivo." *Journal of Virology* 88, No. 21 (2014): 12669-12682.
"Structures of Broadly Neutralizing Anti-HIV Antibodies that Target the CD4 Binding Site on the HIV Envelope" *SSRL Science Highlight*, Mar. 2012, available at http://www-ssrl.slac.stanford.edu/content/sites/default/files/documents/science-highlights/pdf/hiv_antibodies-201203.pdf (last accessed May 28, 2014).

(Continued)

*Primary Examiner* — Jeffrey Parkin
(74) *Attorney, Agent, or Firm* — Klarquist Sparkman, LLP

(57) ABSTRACT

Monoclonal neutralizing antibodies that specifically bind to HIV-1 gp120 and antigen binding fragments of these antibodies are disclosed. Nucleic acids encoding these antibodies, vectors and host cells are also provided. Methods for detecting HIV using these antibodies are disclosed. In addition, the use of these antibodies, antigen binding fragment, nucleic acids and vectors to prevent and/or treat an HIV infection is disclosed.

41 Claims, 87 Drawing Sheets

FOREIGN PATENT DOCUMENTS

| | | |
|---|---|---|
| WO | WO/2008/025015 | 2/2008 |
| WO | WO 2009/100376 | 8/2009 |
| WO | WO 2011/038290 | 3/2011 |
| WO | WO 2011/046623 | 4/2011 |
| WO | WO 2012/040562 | 3/2012 |
| WO | WO 2012/154312 | 11/2012 |
| WO | WO 2012/158948 | 11/2012 |
| WO | WO 2013/016468 | 1/2013 |
| WO | WO 2013/142324 | 9/2013 |
| WO | WO/2013/163427 | 10/2013 |
| WO | WO 2014/043386 | 3/2014 |

OTHER PUBLICATIONS

Al-Lazikani et al., "Standard Conformations for the Canonical Structures of Immunoglobulins", J. Mol. Biol., 273:927-948, 1997.

Anderson et al., "Testing the hypothesis of a recombinant origin of human immunodeficiency virus type 1 subtype E," J. Virol., 74:10752-10765, 2000.

Balazs et al., "Vectored immunoprophylaxis protects humanized mice from mucosal HIV transmission." Nature medicine (2014).

Bell et al., "Structure of antibody F425-B4e8 in complex with a V3 peptide reveals a new binding mode for HIV-1 neutralization," J. Molecular Biol., 375:969-978, 2008.

Binley et al., "Comprehensive cross-clade neutralization analysis of a panel of anti-human immunodeficiency virus type 1 monoclonal antibodies," J. Virol., 78:13232-13252, 2004.

Binley et al., "Profiling the specificity of neutralizing antibodies in a large panel of plasmas from patients chronically infected with human immunodeficiency virus type 1 subtypes B and C," J. Virol., 82:11651-11668, 2008.

Bonsignori et al., "Analysis of a clonal lineage of HIV-1 envelope V2/V3 conformational epitope-specific broadly neutralizing antibodies and their inferred unmutated common ancestors." J. Virol. 85.19 (2011): 9998-10009.

Bonsignori et al., "Two distinct broadly neutralizing antibody specificities of different clonal lineages in a single HIV-1-infected donor: implications for vaccine design." J. Virol. 86.8 (2012): 4688-4692.

Burton et al., "Efficient neutralization of primary isolates of HIV-1 by a recombinant human monoclonal antibody," Science, 266:1024-1027, 1994.

Burton et al., "HIV vaccine design and the neutralizing antibody problem," Nat. Immunol., 5:233-236, 2004.

Burton, "Antibodies, viruses and vaccines," Nat. Rev. Immunol., 2:706-713, 2002.

Burton et al., "Broadly Neutralizing Antibodies Present New Prospects to Counter Highly Antigenically Diverse Viruses," Science 337, 183-186 (2012).

Chen et al., "Structural basis of immune evasion at the site of CD4 attachment on HIV-1 gp120," Science, 326:5956, pp. 1123-1127, Nov. 2009.

Chen et al., "Structure of an unliganded simian immunodeficiency virus gp120 core," Nature, 433:834-841, 2005.

Corti et al., "Analysis of memory B cell responses and isolation of novel monoclonal antibodies with neutralizing breadth from HIV-1-infected individuals," PLoS One, 5:e8805, 2010 (15 pages).

Decker et al., "Antigenic conservation and immunogenicity of the HIV coreceptor binding site," J. Exp. Med., 201:1407-1419, 2005.

Deeks et al., "Neutralizing antibody responses against autologous and heterologous viruses in acute versus chronic human immunodeficiency virus (HIV) infection: evidence for a constraint on the ability of HIV to completely evade neutralizing antibody responses," J. Virol., 80:6155-6164, 2006.

Dey et al., "Characterization of human immunodeficiency virus type 1 monomeric and trimeric gp120 glycoproteins stabilized in the CD4-bound state: antigenicity, biophysics, and immunogenicity," J. Virol., 81:5579-5593, 2007.

Dey et al., "Structure-based stabilization of HIV-1 gp120 enhances humoral immune responses to the induced co-receptor binding site," PLoS Pathog., 5:e1000445, 2009 (15 pages).

Dhillon et al., "Dissecting the neutralizing antibody specificities of broadly neutralizing sera from human immunodeficiency virus type 1-infected donors," J. Virol., 81:6548-6562, 2007.

Dimitrov, "Antibody therapeutics, vaccines and antibodyomes," mAbs, 2:347-356, 2010.

Diskin et al., "Structure of a clade C HIV-1 gp120 bound to CD4 and CD4-induced antibody reveals anti-CD4 polyreactivity," Nat. Struct. Mol. Biol., 17:608-613, 2010.

Diskin et al., "Increasing the Potency and Breadth of an HIV Antibody by using Structure-Based Rational Design," Science 334: 1289-1293 (2011).

Doria-Rose et al., "Breadth of human immunodeficiency virus-specific neutralizing activity in sera: clustering analysis and association with clinical Variables," J. Virol., 84:1631-1636, 2010.

Doria-Rose et al., "Frequency and phenotype of human immunodeficiency virus envelope-specific B cells from patients with broadly cross-neutralizing antibodies," J. Virol., 83:188-199, 2009.

Finzi et al., "Topological layers in the HIV-1 gp120 inner domain regulate gp41 interaction and CD4-triggered conformational transitions," Mol. Cell. 37:656-676, 2010.

Forsman et al., "Llama antibody fragments with cross-subtype human immunodeficiency virus type 1 (HIV-1)-neutralizing properties and high affinity for HIV-1 gp120," J. Virol., 82:12069-12081, 2008.

Gnanakaran et al., "Genetic signatures in the envelope glycoproteins of HIV-1 that associate with broadly neutralizing antibodies," PLoS Comput. Biol., 6:e1000955, 2010 (26 pages).

Gray et al., "Antibody specificities associated with neutralization breadth in plasma from human immunodeficiency virus type 1 subtype C-infected blood donors," J. Virol., 83:8925-8937, 2009.

Haim et al., "Soluble CD4 and CD4-mimetic compounds inhibit HIV-1 infection by induction of a short-lived activated state," PLoS Pathog., 5:e1000360, 2009 (13 pages).

Haynes et al., "B-cell-lineage immunogen design in vaccine development with HIV-1 as a case study." Nature Biotechnology 30.5 (2012): 423-433.

Huang et al., "Structural basis of tyrosine sulfation and VH-gene usage in antibodies that recognize the HIV type 1coreceptor-binding site on gp120," Proc. Natl. Acad. Sci. U.S.A., 101:2706-2711, 2004.

Huang et al., "Structure of a V3-Containing HIV-1 gp120 Core," Science, 310:1025-1028, 2005.

Huang et al., "Structures of the CCR5 N Terminus and of a Tyrosine-Sulfated Antibody with HIV-1 gp120 and CD4," Science, 317:1930-1934, 2007.

Kassa et al., "Transitions to and from the CD4-Bound Conformation Are Modulated by a Single-Residue Change in the Human Immunodeficiency Virus Type 1 gp120 Inner Domain," J. Virol., 83:8364-8378, 2009.

Keele et al., "Identification and characterization of transmitted and early founder virus envelopes in primary HIV-1 infection," Proc. Natl. Acad. Sci. U.S.A., 105:7552-7557, 2008.

Klein et al., "Broad neutralization by a combination of antibodies recognizing the CD4 binding site and a new conformational epitope on the HIV-1 envelope protein," J. Exp. Med. 209(8): 1469-1479 (2012).

Korber et al., "The implications of patterns in HIV diversity for neutralizing antibody induction and susceptibility," Curr. Opin. HIV AIDS, 4:408-417, 2009.

Korber et al., "Numbering positions in HIV relative to HXB2CG." Human retroviruses and AIDS 3: 102-111 (1998).

Kwon et al., "Structure-Guided Modification and Optimization of Antibody VRC07," Retrovirology, 9(Suppl 2): O34, 2012.

Kwong et al., "Human Antibodies that Neutralize HIV-1: Identification, Structures, and B Cell Ontogenies," Immunity, 37:412-425, 2012.

Kwong et al., "HIV-1 evades antibody-mediated neutralization through conformational masking of receptor-binding sites," Nature, 420:678-682, 2002.

Kwong et al., "Structure of an HIV gp120 envelope glycoprotein in complex with the CD4 receptor and a neutralizing human antibody," Nature, 393:648-659, 1998.

Kwong et al., "Structures of HIV gp120 envelope glycoproteins from laboratory-adapted and primary isolates," Structure, 8:1329-1339, 2000.

Kwong et al., "Affinity Maturation Allows VRC01-like Antibodies to Converge on a Common Mode of Effective HIV-1 Neutralization" AIDS Vaccine 2010, Atlanta Georgia (2010), available at: http://www.vaccineenterprise.org/conference_archive/2010/pdf-presentations/Wednesday/Oral-Abstract-05/KwongP1.pdf, last accessed Jun. 9, 2014.

Kwong et al., "Affinity Maturation Allows VRC01-like Antibodies to Converge on a Common Mode of Effective HIV-1 Neutralization"—Oral Abstract, p. 74—AIDS Vaccine 2010, Atlanta Georgia (2010), available at: http://www.vaccineenterprise.org/conference_archive/2010/pdf/Oral-Abstract-Session-05.pdf, last accessed Jun. 9, 2014.

Lefranc et al., "IMGT Unique Numbering for Immunoglobulin and T Cell Receptor Variable Domains and Ig Superfamily V-like Domains," *Dev. Comp. Immunol.*, 27:55-77, 2003.

Li et al., "Analysis of neutralization specificities in polyclonal sera derived from human immunodeficiency virus type 1-infected individuals," *J. Virol.*, 83:1045-1059, 2009.

Li et al., "Broad HIV-1 neutralization mediated by CD4-binding site antibodies," *Nature Medicine*, 13:9, pp. 1032-1034, Sep. 2007.

Li et al., "Genetic and Neutralization Properties of Subtype C Human Immunodeficiency Virus Type 1 Molecular env Clones from Acute and Early Heterosexually Acquired Infections in Southern Africa," *J. Virol.*, 80:11776-11790, 2006.

Li et al., "Human Immunodeficiency Virus Type 1 env Clones from Acute and Early Subtype B Infections for Standardized Assessments of Vaccine-Elicited Neutralizing Antibodies," *J. Virol.*, 79:10108-10125, 2005.

Li et al., "Mechanism of neutralization by the broadly neutralizing HIV-1 monoclonal antibody VRC01," *J. Virol.*, 85:8954-8967, 2011.

Liao et al., "Co-evolution of a broadly neutralizing HIV-1 antibody and founder virus." *Nature* 496.7446 (2013): 469-476.

Longo et al., "Analysis of somatic hypermutation in X-linked hyper-IgM syndrome shows specific deficiencies in mutational targeting," *Blood*, 113:3706-3715, 2009.

Lynch, et al. "The Development of CD4 Binding Site Antibodies during HIV-1 Infection," *J. Virol.* 86(14): 7588-7595 (2012).

Madani et al., "Small-molecule CD4 mimics interact with a highly conserved pocket on HIV-1 gp120," *Structure*, 16:1689-1701, 2008.

Martin et al., "Rational design of a CD4 mimic that inhibits HIV-1 entry and exposes cryptic neutralization epitopes," *Nat. Biotechnol.*, 21:71-76, 2003.

Mascola et al., "Human immunodeficiency virus type 1 neutralization measured by flow cytometric quantitation of single-round infection of primary human T cells," *J. Virol.*, 76:4810-4821, 2002.

Mascola et al., "The role of antibodies in HIV vaccines.," *Ann. Rev. Immunol.*, 28:413-444, 2010.

McCoy et al., "Potent and broad neutralization of HIV-1 by a llama antibody elicited by immunization," *J. Exp. Med.* 209(6): 1091-1103 (2012).

Montefiori et al., "Neutralizing and other antiviral antibodies in HIV-1 infection and vaccination," *Curr. Opin. HIV AIDS*, 2:169-176, 2007.

Moore et al., "Antibody cross-competition analysis of the human immunodeficiency virus type 1 gp120 exterior envelope glycoprotein," *J. Virol.*, 70:1863-1872, 1996.

Myszka et al., "Energetics of the HIV gp120-CD4 binding reaction," *Proc. Natl. Acad. Sci. U.S.A.*, 97:9026-9031, 2000.

Nakamura et al., "Coverage of primary mother-to-child HIV transmission isolates by second-generation broadly neutralizing antibodies." *AIDS* (London, England) 27(3) (2013).

Neith, "Building Better HIV Antibodies," Caltech Media Relations, published Oct. 27, 2011, available at http://www.caltech.edu/article/13468 (last accessed May 28, 2013).

Pantophlet et al., "GP120: target for neutralizing HIV-1 antibodies," *Ann. Rev. Immunol.*, 24:739-769, 2006.

Prabakaran et al., "Structural Mimicry of CD4 by a Cross-reactive HIV-1 Neutralizing Antibody with CDR-H2 and H3 Containing Unique Motifs," *J. Mol. Biol.*, 357:82-89, 2006.

Prabakaran et al., "Structure of severe acute respiratory syndrome coronavirus receptor-binding domain complexed with neutralizing antibody," *J. Biol. Chem.*, 281:15829-15836, 2006.

Richman et al., "Rapid evolution of the neutralizing antibody response to HIV type 1 infection," *Proc. Natl. Acad. Sci. U.S.A.*, 100:4144-4149, 2003.

Rits-Volloch et al., "Restraining the conformation of HIV-1 gp120 by removing a flexible loop," *EMBO J.*, 25:5026-5035, 2006.

Robinson et al. "Mesothelin-family proteins and diagnosis of mesothelioma." *The Lancet* 362(9396): 1612-1616 (2003) (Abstract).

Rossmann, "The canyon hypothesis: Hiding the host cell receptor attachment site on a viral surface from immune surveillance," *J. Biol. Chem.*, 264:14587-14590, 1989.

Sakihama et al., "Oligomerization of CD4 is required for stable binding to class II major histocompatibility complex proteins but not for interaction with human immunodeficiency virus gp120," *Proc. Natl. Acad. Sci. U.S.A.*, 92:6444-6448, 1995.

Sanders et al., "The Mannose-Dependent Epitope for Neutralizing Antibody 2G12 on Human Immunodeficiency Virus Type 1 Glycoprotein gp120," *J. Virol.*, 76:7293-7305, 2002.

Sather et al., "Factors associated with the development of cross-reactive neutralizing antibodies during human immunodeficiency virus type 1 infection," *J. Virol.*, 83:757-769, 2009.

Scheid et al., "Broad diversity of neutralizing antibodies isolated from memory B cells in HIV-infected individuals," *Nature*, 458:636-640, 2009.

Scheid et al., "Sequence and Structural Convergence of Broad and Potent HIV Antibodies That Mimic CD4 Binding," *Science* 333: 1633-1637 (2011).

Schied et al., "A method for identification of HIV gp140 binding memory B cells in human blood," *J. Immunol. Methods*, 343:65-67, 2009.

Seaman et al., "Tiered categorization of a diverse panel of HIV-1 Env pseudoviruses for assessment of neutralizing antibodies," *J. Virol.*, 84:1439-1452, 2010.

Shu et al., "Efficient protein boosting after plasmid DNA or recombinant adenovirus immunization with HIV-1 vaccine constructs," *Vaccine*, 25:1398-1408, 2007.

Simek et al., "Human immunodeficiency virus type 1 elite neutralizers: Individuals with broad and potent neutralizing activity identified by using a high-throughput neutralization assay together with an analytical selection algorithm," *J. Virol.*, 83:7337-7348, 2009.

Smith et al., "Lack of neutralizing antibody response to HIV-1 predisposes to superinfection," *Virology*, 355:1-5, 2006.

Stamatatos et al., "Neutralizing antibodies generated during natural HIV-1 infection: good news for an HIV-1 vaccine?," *Nat. Med.*, 15:866-870, 2009.

Thomson et al., "Germline V-genes sculpt the binding site of a family of antibodies neutralizing human cytomegalovirus," *EMBO J.*, 27:2592-2602, 2008.

Tiller et al., "Efficient generation of monoclonal antibodies from single human B cells by single cell RT-PCR and expression vector cloning," *J. Immunol. Methods.*, 329:112-124, 2008.

Walker et al., "Broad and potent neutralizing antibodies from an African donor reveal a new HIV-1 vaccine target," *Science*, 326:285-289, 2009.

Walker et al., "Mapping Broadly Neutralizing Antibody Specificities in Donor Sera."—AIDS Vaccine 2010, Atlanta Georgia (2010), available at: http://www.vaccineenterprise.org/conference_archive/2010/pdf-presentations/Thursday/Symposium-06/WalkerL.pdf, last accessed Jun. 9, 2014.

Wardemann et al., "Predominant autoantibody production by early human B cell precursors," *Science*, 301:1374-1377, 2003.

West et al., "Structural basis for germ-line gene usage of a potent class of antibodies targeting the CD4-binding site of HIV-1 gp120," *Proceedings of the National Academy of Sciences* 109(30): E2083-E2090 (2012).

Wrammert et al., "Rapid cloning of high-affinity human monoclonal antibodies against influenza virus," *Nature*, 453:667-671, 2008.

Wu et al., "Enhanced exposure of the CD4-binding site to neutralizing antibodies by structural design of a membrane-anchored human immunodeficiency virus type 1 gp120 domain," *J. Virol.*, 83:10, pp. 5077-5086, May 2009.

Wu et al., "Focused evolution of HIV-1 neutralizing antibodies revealed by structures and deep sequencing," *Science*, 333(6049): 1593-1602 (2011).

Wu et al., "Mechanism of human immunodeficiency virus type 1 resistance to monoclonal antibody B12 that effectively targets the site of CD4 attachment," *J. Virol.*, 83:21, pp. 10892-10907, Nov. 2009.

Wu et al., "Rational design of envelope identifies broadly neutralizing human monoclonal antibodies to HIV-1," *Science*, 329:(5993): 856-861 (2010).

Wu et al., "Soluble CD4 broadens neutralization of V3-directed monoclonal antibodies and guinea pig vaccine sera against HIV-1 subtype B and C reference viruses," *Virology*, 380:285-295, 2008.

Wyatt et al., "The antigenic structure of the HIV gp120 envelope glycoprotein," *Nature*, 393:705-711, 1998.

Xiang et al., "Mutagenic Stabilization and/or Disruption of a CD4-Bound State Reveals Distinct Conformations of the Human Immunodeficiency Virus Type 1 gp120 Envelope Glycoprotein," *J. Virol.*, 76:9888-9899, 2002.

Xiao et al., "Germline-like predecessors of broadly neutralizing antibodies lack measurable binding to HIV-1 envelope glycoproteins: implications for evasion of immune response and design of vaccine immunogens," *Biochem. Biophys. Res. Commun.*, 390:404-409, 2009.

Xiao et al., "Maturation pathways of cross-reactive HIV-1, Neutralizing Antibodies," *Viruses*, 1:802-817, 2009.

Zhou et al., "Structural basis for broad and potent neutralization of HIV-1 by antibody VRC01," *Science*, 329:5993, pp. 811-817, Aug. 2010.

Zhou et al., "Structural definition of a conserved neutralization epitope on HIV-1 33gp120," *Nature*, 445:732-737, 2007.

Zolla-Pazner, "Identifying epitopes of HIV-1 that induce protective antibodies," *Nat. Rev. Immunol.*, 4:199-210, 2004.

International Search Report and Written Opinion issued by the European Patent Office on May 13, 2010 in PCT application PCT/US2010/050295 (16 pages).

Giudicelli et al. "Imgt-ontology 2012." *Frontiers in genetics* 3 (2012).

* cited by examiner

FIG. 1A
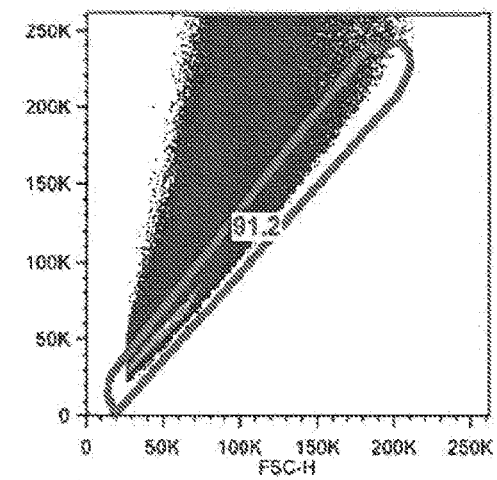
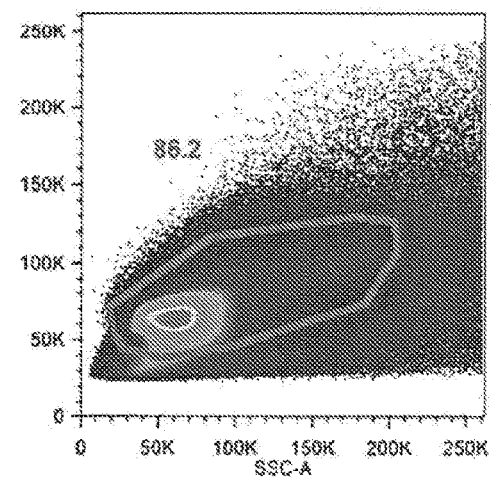
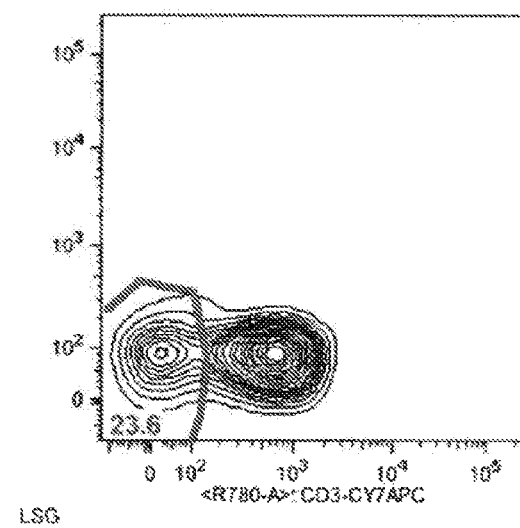
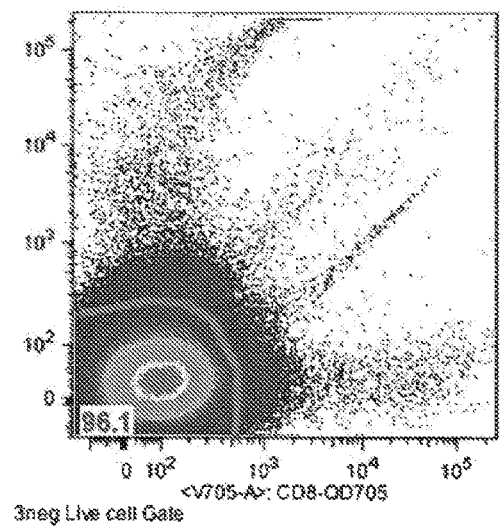

VRC07b and VRC07c were identified from these sorted cells

FIG. 2

```
Heavy chain
            -------FR1--------    ___CDR1___   ------FR2------  ____CDR2____    --------------FR3---------------                              ___CDR3___              ----FR4----
IGHV1-2*02  QVQLVQSGAEVKKPGASVKVSCKASGYTFT GYYMH WVRQAPGQGLEWMG WINPNSGGTNYAQKFQGRVTMTRDTSISTAYMELSRLRSDDTAVYYCAR
VRC07       QVRLSQSGGQMKKPGASVRVSCQASGYEFID CTLNWIRLAPGKRPEWMG WIKPRYGAVNFGGGFRDRVL ELAALRSDDTAVYF CTRGKICTARDYYNWDFEHWGQGTPVTVSS
VRC07b      QVRLSQSGGQMKKPGASVRVSCQASGYEFID CTLNWIRLAPGKRPEWMG WIKPRYGAVNFGGGFRDRVL ELAALRSDDTAVYF CTRGKICTARDYYNWDFEHWGRGTLVTVSS
VRC07c      QVRLSQSGGQMKKPGASVRVSCRASGYEFID CTLNWIRLAPGKRPEWMG WMKPRYGAVNYARQFQGRVTMTRDVYSDTAYL ELRSLRSDDTAVYF CTRGKICTARDYYNWDFEHWGRGTLVTVSS
NIH45-46    QVRLSQSGGQMKRPGESVRISCEASGYNFID CTLNWIRLAPGRLPEWMG WLKPRYGAVNYARKFQGRVTMTRDVYSDTAFL ELRSLRSDDTAVYF CTRGKICTARDYYNWDFEHWGRGAPVTVSS
VRC01       QVQLVQSGGQMKKPGASVKVSCQASGYRFSN FVIHWVRQAPGQRFEWMG WINPYNGNKEFSAKFQDRVTITRDTSASTAYMELSSLRSEDTAMYYC TRGKNCD....YNWDFEHWGRGTPVIVSS
VRC02       QVQLVQSGGQMKKPGASVRVSCQASGYNFRD FIINWLRRAPGQRLEWMG WLNPKTGAVNYARQFQGRVTMTRDVYSDTAYM ELSSLRSEDMAVYYC TRGKNCD....YNWDFEHWGRGTPVIVSS
```

Heavy Chain Nucleotide Sequence Alignment

FIG. 5

Light Chain Protein Sequence Alignment
(CDR sequences underlined)

```
VRC07b  EIVLTQSPATLSLSPGERAILSCRTSQYGSLAWYQQRPGQAPRLVIYAGSTRATGIPDRF
VRC07c  EIVLTQSPATLSLSPGERAILSCRTTQYGSLAWYQQRPGQAPRLVIYAGSTRATGIPDRF
VRC01   EIVLTQSPGTLSLSPGETAILSCRTSQYGSLAWYQQRPGQAPRLVIYSGSTRAAGIPDRF
        ******** ********* ****** ***************** *****  *******

VRC07b  SGSRWGAEYNLTISNLESEDFGVYYCQQYEFFGQGTKVQVDIK-
VRC07c  SGSRWGADYNLTISNLESEDFGVYYCQQYEFFGQGTKVQVDIK-
VRC01   SGSRWGPDYNLTISNLESGDFGVYYCQQYEFFGQGTKVQVDIKR
        ****** ***********.***************** ******
```

FIG. 6

Study: CVL19
Assay: Pseudovirus Neutralization Assay/TZM-bl    Antibody Neutralization Data
Values represent mAb concentration in μg/ml
required to achieve 50% or 80% neutralization

| virus | | Q23.17 Clade A | 0842.012 Clade A | YU2 Clade B | JR-FL Clade B | DU156-12 Clade C | ZM109A Clade C | UG0378 Clade A | MuLV Negative Control | SIVmac251_30_SIV Negative Control |
|---|---|---|---|---|---|---|---|---|---|---|
| VRC01 | IC50 | 0.107 | 0.049 | 0.174 | 0.048 | 0.151 | 0.169 | 0.041 | >50 | >50 |
| CVL19_001CVL19_010 | IC80 | 0.352 | 0.135 | 0.631 | 0.145 | 0.346 | 0.615 | 0.138 | >50 | >50 |
| VRC03 | IC50 | 0.091 | >50 | 0.066 | 0.017 | >50 | >50 | >50 | >50 | >50 |
| CVL19_002 | IC80 | 0.304 | 0.034 | 0.171 | 0.040 | >50 | >50 | >50 | >50 | >50 |
| VRC-PG04 | IC50 | 0.083 | 0.034 | 0.125 | 0.145 | 0.058 | 0.062 | 0.042 | >50 | >50 |
| CVL19_003 | IC80 | 0.263 | 0.104 | 0.429 | 0.579 | 0.165 | 0.306 | 0.170 | >50 | >50 |
| 45-46-1108974H1 | IC50 | 0.053 | 0.018 | 0.051 | 0.010 | 0.036 | 0.047 | 0.027 | >50 | >50 |
| CVL19_015 | IC80 | 0.178 | 0.052 | 0.145 | 0.031 | 0.115 | 0.261 | 0.125 | >50 | >50 |
| 45-08-54180101L | IC50 | 0.112 | 0.034 | 0.222 | 0.094 | 0.065 | 0.132 | 0.072 | >50 | >50 |
| CVL19_015 | IC80 | 0.353 | 0.135 | 0.361 | 0.427 | 0.298 | 0.885 | 0.298 | >50 | >50 |

VRC07 data

FIG. 7A

| Virus ID | Clade | VRC03 | VRC-PG04 | VRC-CH31 | 4E10 | 2G12 | HIVIG | VRC01 | VRC07 |
|---|---|---|---|---|---|---|---|---|---|
| 0260.v5.c36 | A | 0.872 | 0.506 | 0.132 | 31.700 | >50 | 2690 | 0.529 | 0.319 |
| 0330.v4.c3 | A | >50 | 0.083 | 0.038 | 6.860 | 1.070 | 1367 | 0.064 | 0.043 |
| 0439.v5.c1 | A | 0.224 | 0.141 | 0.095 | 8.240 | >50 | 2063 | 0.052 | 0.153 |
| 3365.v2.c20 | A | 2.260 | 0.066 | 0.021 | 1.380 | >50 | 1168 |  | 0.059 |
| 3415.v1.c1 | A | 0.033 | 0.119 | 0.061 | 11.500 | 1.60 | 1595 | 0.092 | 0.122 |
| 3718.v3.c11 | A | >50 | >50 | 0.094 | 8.55 | >50 | >5000 | 0.218 | 0.100 |
| 398-F1_F6_20 | A | 0.171 | 0.048 | 0.039 | 0.784 | 26.90 | 14.3 | 0.058 | 0.058 |
| BB201.B42 | A | 24.600 | 0.105 | 0.034 | 2.190 | 0.456 | 589 | 0.343 | 0.185 |
| BB539.2B13 | A | 10.400 | 1.410 | >50 | 0.712 | >50 | 282 | 0.094 | 0.031 |
| BI369.9A | A | >50 | 0.052 | 0.031 | 1.360 | 1.740 | 374 | 0.149 | 0.09 |
| BS208.B1 | A | 0.263 | 0.029 | 0.013 | 0.618 | >50 | 145 | 0.029 | 0.013 |
| KER2008.12 | A | 0.435 | 0.355 | 0.179 | 1.280 | 2.890 | 253 | 0.563 | 0.387 |
| KER2018.11 | A | 0.415 | 0.592 | 0.513 | 8.460 | >50 | 3332 | 0.070 | 0.501 |
| KNH1209.18 | A | 20.70 | 0.081 | 0.068 | 1.63 | 1.100 | 288 | 0.087 | 0.086 |
| MB201.A1 | A | >50 | 0.099 | 0.040 | 2.210 | >50 | 344 | 0.237 | 0.173 |
| MB539.2B7 | A | >50 | 0.582 | 0.260 | 21.70 | >50 | >5000 | 0.544 | 0.386 |
| MI369.A5 | A | >50 | 0.076 | 0.033 | 2.880 | 3.970 | 1192 | 0.162 | 0.144 |
| MS208.A1 | A | >50 | 0.073 | 0.052 | 1.560 | >50 | 1196 | 0.147 | 0.11 |
| Q168.a2 | A | 3.050 | 0.062 | 0.038 | 18.700 | >50 | 2118 | 0.140 | 0.095 |
| Q23.17 | A | 0.041 | 0.028 | 0.023 | 0.132 | >50 | 369 | 0.086 | 0.024 |
| Q259.17 | A | 0.021 | >50 | 4.910 | 10.200 | >50 | 741 | 0.051 | 0.038 |
| Q461.e2 | A | >50 | 0.342 | 0.159 | 5.530 | >50 | >5000 | 0.410 | 0.3 |
| Q769.d22 | A | 0.020 | 0.038 | 0.036 | 1.73 | >50 | 310 | 0.015 | 0.0 |
| Q769.h5 | A | 0.025 | 0.020 | 0.015 | 1.170 | >50 | 321 | 0.014 | 0.019 |
| Q842.d12 | A | >50 | 0.018 | 0.007 | 8.990 | >50 | 568 | 0.006 | 0.014 |
| QH209.14M.A2 | A | >50 | 0.046 | 0.030 | 5.930 | >50 | 414 | 0.024 | 0.038 |
| RW020.2 | A | >50 | 0.111 | 0.024 | 8.210 | >50 | 451 | 0.303 | 0.134 |
| UG037.8 | A | >50 | 0.063 | 0.047 | 0.504 | >50 | 1087 | 0.035 | 0.053 |
| 3301.V1.C24 | AC | 0.098 | 0.034 | 0.023 | 8.640 | >50 | 1110 | 0.084 | 0.023 |
| 3589.V1.C4 | AC | >50 | >50 | 0.374 | 1.940 | 2.2 |  | 0.073 | 0.056 |
| 6540.v4.c1 | AC | >50 | >50 | >50 | 14.300 | >50 | 1237 | >50 | >50 |
| 6545.V3.C13 | AC | >50 | >50 | >50 | 6.070 | >50 | 361 |  | >50 |
| 6545.V4.C1 | AC | >50 | >50 | >50 | 12.5 | >50 | 1507 | >50 | >50 |
| 0815.V3.C3 | ACD | 0.043 | 0.091 | 0.042 | 1.660 | >50 | 693 | 0.036 | 0.042 |
| 6095.V1.C10 | ACD | >50 | 0.704 | 0.228 | 0.004 | >50 | 3.49 | 0.464 | 0.080 |
| 3468.V1.C12 | AD | >50 | 0.038 | 0.023 | 0.964 | >50 | 1100 | 0.040 | 0.023 |
| 620345.c1 | AE | >50 | >50 | >50 | 0.469 | >50 | 106 | >50 | >50 |
| C1080.c3 | AE | >50 | 1.780 | 1.270 | 0.598 | >50 | 260 | 1.50 | 0.541 |
| C2101.c1 | AE | >50 | 0.135 | 0.130 | 2.5 | >50 | 403 | 0.097 | 0.225 |
| C3347.c11 | AE | 0.677 | >50 | 0.049 | 0.161 | >50 | 46.4 | 0.037 | 0.057 |
| C4118.09 | AE | >50 | 0.121 | 0.194 | 5.260 | >50 | 668 | 0.110 | 0.089 |
| CNE3 | AE | >50 | >50 | >50 | 2.230 | >50 | 503 | 3.56 | 3.33 |
| CNE5 | AE | 6.580 | 0.386 | 0.946 | 2.99 | >50 |  | 0.228 | 0.144 |
| CNE55 | AE | 0.746 | 0.096 | 0.042 | 0.901 | >50 |  | 0.292 | 0.135 |
| CNE56 | AE | >50 | 0.535 | 0.147 | 0.207 | >50 | 335 | 0.442 | 0.299 |
| CNE59 | AE | >50 | 0.315 | 0.220 | 0.042 | >50 | 157 | 0.516 | 0.262 |
| M02138 | AE | >50 | 0.385 | 0.693 | 0.151 | >50 | 433 | 0.742 | 0.3 |
| R1166.c1 | AE | >50 | 1.260 | 0.310 | 2.690 | >50 | 1081 | 1.77 | 1.520 |
| R2184.c4 | AE | 0.054 | 0.054 | 0.045 | 3.790 | >50 | 4354 | 0.052 | 0.1 |
| R3265.c6 | AE | >50 | >50 | 0.402 | 15.600 | >50 | 431 | 0.731 | 0.233 |
| TH966.8 | AE | >50 | 0.227 | 0.177 | 0.079 | >50 | 208 | 0.331 | 0.163 |

FIG. 7B

| Virus ID | Clade | VRC03 | VRC-PG04 | VRC-CH31 | 4E10 | 2G12 | HIVIG | VRC01 | VRC07 |
|---|---|---|---|---|---|---|---|---|---|
| TH976.17 | AE | >50 | 0.023 | 0.023 | 0.213 | >50 | 164 | 0.066 | 0.102 |
| 235-47 | AG | 0.540 | 0.008 | 0.005 | 0.802 | 0.88 | 212 | 0.049 | 0.01 |
| 242-14 | AG | >50 | >50 | >50 | >50 | >50 | 1071 | >50 | 2.380 |
| 263-8 | AG | 0.019 | 0.0 | 0.0 | 0.319 | 2.150 | 175 | 0.119 | 0.039 |
| 269-12 | AG | >50 | >50 | 0.041 | 0.133 | >50 | 687 | 0.163 | 0.032 |
| 271-11 | AG | >50 | 0.063 | 0.044 | 3.110 | >50 | 690 | 0.052 | 0.043 |
| 928-28 | AG | >50 | 3.700 | 0.041 | 0.009 | >50 | 103 | 0.378 | 0.01 |
| DJ263.8 | AG | >50 | 3.120 | 0.117 | 0.081 | 0.023 | 9.92 | 0.072 | 0.030 |
| T250-4 | AG | >50 | >50 | >50 | 0.361 | 22.600 | 457 | >50 | >50 |
| T251-18 | AG | >50 | 0.677 | 0.171 | 9.420 | 10.70 | >5000 | 3.58 | 1.200 |
| T253-11 | AG | >50 | 0.176 | 0.431 | 0.755 | >50 |  | 0.265 | 0.2 |
| T255-34 | AG | >50 | 1.300 | 0.031 | 0.023 | >50 |  | 0.252 | 0.059 |
| T257-31 | AG | >50 | 0.573 | 0.165 | 2.000 | >50 | 2052 | 1.68 | 0.259 |
| T266-60 | AG | >50 | 0.1 | 0.1 | 4.740 | >50 | 2500 | 0.353 | 0.247 |
| T278-50 | AG | >50 | >50 | >50 | 3.17 | >50 | 1820 | >50 | >50 |
| T280-5 | AG | 0.027 | 0.014 | 0.022 | 0.726 | >50 | 154 | 0.017 | 0.006 |
| T33-7 | AG | >50 | 0.003 | 0.001 | 2.9 | >50 | 761 | 0.023 | 0.001 |
| 3988.25 | B | 3.870 | 0.757 | >50 | 1.370 | 0.780 | 242 | 2.10 | 0.111 |
| 5768.04 | B | 0.575 | 0.285 | 1.090 | 15.000 | 3.070 | 244 | 0.099 | 0.110 |
| 6101.10 | B | 0.047 | 0.133 | 0.319 | 0.381 | 1.7 | 1296 | 0.104 | 0.03 |
| 6535.3 | B | 1.320 | 0.774 | >50 | 0.458 | 1.70 | 58.7 | 2.16 | 0.206 |
| 7165.18 | B | >50 | >50 | >50 | 0.895 | 0.393 | 260 | >50 | 8.270 |
| 89.6.DG | B | 0.165 | 0.108 | 0.098 | 1.020 | 0.27 | 47.6 | 0.460 | 0.240 |
| AC10.29 | B | >50 | >50 | 46.100 | 0.408 | >50 | 618 | 1.43 | 0.419 |
| ADA.DG | B | 0.126 | 0.408 | 0.288 | 0.656 | 11.400 | 99.1 | 0.424 | 0.158 |
| Bal.01 | B | >50 | 0.121 | 0.123 | 6.740 | 3.270 | 174 | 0.102 | 0.031 |
| BaL.26 | B | 28.10 | 0.426 | 0.044 | 2.700 | 0.945 | 101 | 0.047 | 0.015 |
| BG1168.01 | B | >50 | 0.882 | 0.814 | 3.340 | >50 | 2352 | 0.449 | 0.345 |
| BL01.DG | B | >50 | >50 | >50 | 4.680 | 4.7 | 1327 | >50 | >50 |
| BR07.DG | B | 3.230 | 1.770 | 1.340 | 2.010 | 2.240 | 246 | 1.67 | 0.477 |
| BX08.16 | B | 0.10 | 0.362 | 0.914 | 0.469 | 7.690 | 43.4 | 0.281 | 0.086 |
| CAAN.A2 | B | 8.990 | 1.440 | >50 | 8.490 | >50 | 1197 | 1.06 | 0.369 |
| CNE10 | B | 0.289 | 0.399 | 0.198 | 0.307 | 0.059 | 68.1 | 0.776 | 0.114 |
| CNE12 | B | 0.159 | 0.258 | 0.536 | 1.110 | >50 | 267 | 0.785 | 0.161 |
| CNE14 | B | 0.322 | >50 | 0.388 | 2.520 | >50 | 228 | 0.389 | 0.10 |
| CNE4 | B | 0.429 | 0.488 | 1.150 | 0.1 | 15.200 | 48.2 | 0.871 | 0.150 |
| CNE57 | B | 0.078 | 0.120 | 0.055 | 0.156 | >50 | 28.4 | 0.535 | 0.163 |
| HO86.8 | B | >50 | >50 | >50 | 0.34 | >50 | 14.8 | >50 | >50 |
| HT593.1 | B | 0.185 | 0.230 | 0.202 | 0.397 | 2.160 | 122 | 0.438 | 0.112 |
| HXB2.DG | B | 0.044 | 0.039 | 0.127 | 0.043 | 0.242 | 13.0 | 0.040 | 0.02 |
| JRCSF.JB | B | 0.15 | 0.077 | 0.110 | 4.120 | 0.39 | 63.8 | 0.234 | 0.053 |
| JRFL.JB | B | 0.007 | 0.072 | 0.012 | 5.4 | 0.360 | 212 | 0.033 | 0.009 |
| MN.3 | B | 0.026 | >50 | 0.178 | 0.016 | >50 |  | 0.033 | 0.006 |
| PVO.04 | B | 0.713 | 0.392 | 0.188 | 1.990 | 1.320 | 441 | 0.386 | 0.080 |
| QH0515.01 | B | 0.120 | 0.176 | 0.099 | 2.000 | 0.0 | 306 | 0.52 | 0.597 |
| QH0692.42 | B | 0.471 | 1.920 | 0.944 | 1.600 | 5.9 |  | 1.16 | 1.240 |
| REJO.67 | B | 0.0 | 0.035 | 0.049 | 0.167 | >50 | 33.1 | 0.045 | 0.023 |
| RHPA.7 | B | 3.20 | 0.055 | 0.132 | 13.300 | >50 | 728 | 0.047 | 0.042 |
| SC422.8 | B | 0.036 | 0.045 | 0.143 | 1.490 | 3.5 | 519 | 0.132 | 0.059 |
| SF162.LS | B | 0.023 | 0.055 | 0.079 | 0.412 | 0.9 | 2.43 | 0.237 | 0.043 |
| SS1196.01 | B | 0.022 | 0.066 | 0.110 | 0.686 | 9.660 | 302 | 0.276 | 0.071 |

FIG. 7C

| Virus ID | Clade | VRC03 | VRC-PG04 | VRC-CH31 | 4E10 | 2G12 | HIVIG | VRC01 | VRC07 |
|---|---|---|---|---|---|---|---|---|---|
| THRO.18 | B | >50 | >50 | 37.900 | 1.770 | >50 | >5000 | 4.42 | 3.360 |
| TRJO.58 | B | 0.040 | 0.103 | 0.216 | 8.750 | >50 | 787 | 0.079 | 0.072 |
| TRO.11 | B | 0.066 | 0.072 | 0.042 | 0.599 | 0.51 | 313 | 0.343 | 0.124 |
| WITO.33 | B | >50 | 0.333 | 0.086 | 1.200 | 0.583 | 251 | 0.112 | 0.048 |
| YU2.DG | B | 0.049 | 0.099 | 0.129 | 16.000 | >50 | 1039 | 0.055 | 0.046 |
| CH038.12 | BC | >50 | 0.237 | >50 | 4.57 | 0.106 | 1242 | 0.379 | 0.208 |
| CH070.1 | BC | >50 | 0.435 | 12.300 | 21.400 | >50 | 2562 | 18.7 | 0.448 |
| CH117.4 | BC | 0.12 | 0.022 | >50 | 0.343 | >50 | 48.1 | 0.059 | 0.052 |
| CH181.12 | BC | 8.090 | 0.315 | 0.215 | 5.450 | >50 | 1638 | 0.540 | 0.216 |
| CNE15 | BC | 0.422 | 0.121 | 3.270 | 3.360 | >50 | | 0.080 | 0.028 |
| CNE40 | BC | 0.206 | 0.341 | 0.131 | 0.003 | >50 | 3.84 | 0.425 | 0.045 |
| CNE7 | BC | 0.5 | >50 | >50 | 0.128 | >50 | 802 | 0.540 | 0.077 |
| 286.36 | C | 12.600 | 0.341 | 0.353 | 0.99 | >50 | 1146 | 0.103 | 0.152 |
| 288.38 | C | 0.291 | 0.167 | 0.071 | 0.456 | 12.10 | 511 | 1.52 | 0.253 |
| 0013095-2.11 | C | 0.359 | 0.064 | 1.070 | 0.078 | >50 | 148 | 0.142 | 0.010 |
| 001428-2.42 | C | 0.006 | 0.019 | 0.009 | 9.100 | >50 | 845 | 0.023 | 0.01 |
| 0077_V1.C16 | C | >50 | >50 | >50 | 0.886 | >50 | 109 | 1.04 | 0.088 |
| 00836-2.5 | C | 0.012 | >50 | >50 | 1.430 | >50 | 432 | 0.128 | 0.004 |
| 0921.V2.C14 | C | 0.633 | 0.286 | >50 | 5.630 | >50 | | | 0.105 |
| 16055-2.3 | C | 0.076 | >50 | 0.219 | 4.120 | >50 | 2500 | 0.105 | 0.058 |
| 16845-2.22 | C | >50 | 40.700 | 6.430 | 0.459 | >50 | 1747 | 2.41 | 2.080 |
| 16936-2.21 | C | 0.041 | 0.035 | 0.362 | 1.790 | >50 | 940 | 0.109 | 0.046 |
| 25710-2.43 | C | 0.073 | 0.243 | 0.162 | 0.376 | >50 | 649 | 0.545 | 0.163 |
| 25711-2.4 | C | 0.958 | 0.41 | 0.56 | 6.240 | >50 | 2087 | 0.712 | 0.30 |
| 25925-2.22 | C | 0.136 | 0.297 | 0.284 | 2.230 | >50 | 1684 | 0.559 | 0.195 |
| 26191-2.48 | C | >50 | 0.148 | 0.096 | 4.200 | >50 | 2091 | 0.195 | 0.083 |
| 3168.V4.C10 | C | 0.072 | 0.173 | 0.182 | 2.630 | >50 | | 0.131 | 0.118 |
| 3637.V5.C3 | C | >50 | >50 | 1.160 | 3.510 | >50 | | 4.09 | 0.918 |
| 3873.V1.C24 | C | 0.595 | 0.494 | 34.800 | 3.05 | >50 | | 0.954 | 0.358 |
| 6322.V4.C1 | C | >50 | >50 | >50 | 7.950 | >50 | 4219 | >50 | 0.721 |
| 6471.V1.C16 | C | >50 | >50 | >50 | 23.100 | >50 | >5000 | >50 | >50 |
| 6631.V3.C10 | C | >50 | >50 | >50 | >50 | >50 | 780 | >50 | 6.710 |
| 6644.V2.C33 | C | 0.182 | 0.455 | >50 | 0.781 | >50 | 90.6 | 0.164 | 0.077 |
| 6785.V5.C14 | C | 0.122 | 0.350 | 0.397 | 1.960 | >50 | | 0.332 | 0.276 |
| 6838.V1.C35 | C | 1.550 | 0.427 | 3.690 | 1.660 | >50 | 522 | | 0.149 |
| 96ZM651.02 | C | >50 | 2.850 | 1.260 | 0.113 | >50 | 400 | 0.525 | 0.088 |
| BR025.9 | C | >50 | 7.290 | 2.330 | 3.730 | 0.45 | 168 | 0.271 | 0.027 |
| CAP210.E8 | C | >50 | >50 | >50 | 4.000 | >50 | 3606 | >50 | >50 |
| CAP244.D3 | C | >50 | 0.245 | 0.167 | 1.980 | >50 | 3316 | 0.857 | 0.501 |
| CAP45.G3 | C | >50 | >50 | >50 | 2.360 | >50 | 109 | 9.47 | 0.277 |
| CNE30 | C | >50 | 1.360 | 0.519 | 1.7 | >50 | | 0.927 | 0.421 |
| CNE31 | C | 0.629 | 0.678 | 0.928 | 3.120 | >50 | | 0.962 | 0.148 |
| CNE53 | C | 7.720 | 0.060 | 0.046 | 0.032 | >50 | 8.92 | 0.108 | 0.002 |
| CNE58 | C | 5.040 | 0.879 | 0.052 | 0.870 | >50 | 196 | 0.124 | 0.08 |
| DU123.06 | C | >50 | >50 | >50 | 0.343 | >50 | 928 | 13.6 | 0.430 |
| DU151.02 | C | >50 | 0.102 | 0.038 | 2.970 | >50 | 1561 | 7.70 | 1.350 |
| DU156.12 | C | >50 | 0.057 | 3.180 | 0.023 | >50 | 1.39 | 0.082 | 0.023 |
| DU172.17 | C | >50 | 0.232 | 0.275 | 0.023 | >50 | 494 | >50 | 0.124 |
| DU422.01 | C | >50 | >50 | >50 | 1.850 | >50 | 1468 | >50 | >50 |
| MW965.26 | C | 4.30 | 0.056 | 1.890 | 0.025 | >50 | 6.96 | 0.038 | 0.039 |
| SO18.18 | C | 0.154 | 0.097 | 0.190 | 8.790 | >50 | 1884 | 0.071 | 0.043 |

FIG. 7D

| Virus ID | Clade | VRC03 | VRC-PG04 | VRC-CH31 | 4E10 | 2G12 | HIVIG | VRC01 | VRC07 |
|---|---|---|---|---|---|---|---|---|---|
| TV1.29 | C | >50 | >50 | >50 | 1.950 | 8.2 | 1096 | >50 | >50 |
| TZA125.17 | C | >50 | >50 | >50 | 0.431 | >50 | 605 | >50 | 9.710 |
| TZBD.02 | C | 2.280 | 0.117 | 0.15 | 2.320 | >50 | 1316 | 0.072 | 0.036 |
| ZA012.29 | C | 17.700 | 0.187 | 0.056 | 5.800 | >50 | 3088 | 0.250 | 0.151 |
| ZM106.9 | C | 0.139 | 0.234 | 2.590 | 16.10 | >50 | 3588 | 0.248 | 0.180 |
| ZM109.4 | C | >50 | 0.023 | 0.031 | 0.708 | >50 | 996 | 0.134 | 0.050 |
| ZM135.10a | C | >50 | >50 | 0.355 | 0.034 | >50 | 177 | 1.28 | 0.054 |
| ZM176.66 | C | 0.03 | 0.129 | 0.028 | 0.669 | >50 | 424 | 0.038 | 0.016 |
| ZM197.7 | C | 1.75 | 1.500 | 0.605 | 0.425 | >50 | 704 | 0.624 | 0.259 |
| ZM214.15 | C | >50 | 0.112 | 0.147 | 1.450 | >50 | 766 | 0.881 | 0.121 |
| ZM215.8 | C | >50 | 0.047 | 0.124 | 0.641 | >50 | 555 | 0.276 | 0.039 |
| ZM233.6 | C | >50 | 6.030 | >50 | 2.06 | >50 | 570 | 4.25 | 0.218 |
| ZM249.1 | C | >50 | 0.044 | 0.036 | 2.750 | >50 | 981 | 0.082 | 0.061 |
| ZM53.12 | C | 9.930 | 1.290 | 2.640 | 4.520 | >50 | 2547 | 0.839 | 0.288 |
| ZM55.28a | C | >50 | 0.455 | 0.893 | 8.790 | >50 | 1333 | 0.144 | 0.077 |
| 3326.V4.C3 | CD | >50 | >50 | >50 | 1.930 | >50 | 449 | 0.073 | 0.036 |
| 3337.V2.C6 | CD | >50 | 0.040 | 0.885 | 1.910 | >50 | 255 | 0.063 | 0.057 |
| 3817.v2.c59 | CD | >50 | 4.630 | 0.569 | 4.78 | 5.7 | 3614 | >50 | 3.210 |
| 231965.c1 | D | 39.500 | 0.114 | 1.070 | 21.700 | >50 | >5000 | 0.487 | 0.062 |
| 247-23 | D | >50 | >50 | >50 | 2.370 | >50 | 1327 | 24.2 | >50 |
| 3016.v5.c45 | D | >50 | >50 | >50 | 4.800 | >50 | 3365 | 0.111 | 0.217 |
| 57128.vrc15 | D | >50 | >50 | 45.100 | 1.930 | 2.030 | 469 | >50 | 3.550 |
| 6405.v4.c34 | D | >50 | 0.903 | 0.204 | 3.920 | 9.350 | 1406 | 2.63 | 0.546 |
| A03349M1.vrc4a | D | >50 | 4.320 | 1.450 | 3.120 | >50 | 667 | 4.66 | 3.270 |
| NKU3006.ec1 | D | 0.093 | 0.490 | 0.141 | 5.830 | >50 | >5000 | 0.506 | 0.751 |
| UG021.16 | D | >50 | >50 | 0.126 | 0.196 | 8.740 | 24.7 | 0.266 | 0.073 |
| UG024.2 | D | >50 | 0.171 | 0.864 | 0.091 | 0.16 | 41.7 | 0.106 | 0.1 |
| X2088.c9 | G | >50 | >50 | >50 | >50 | >50 | 3943 | >50 | >50 |
| SIVmac251.30.SG3 | NA | >50 | >50 | >50 | >50 | >50 | >5000 | >50 | >50 |
| SVA.MLV | NA | >50 | >50 | >50 | >50 | >50 | >2500 | >50 | >50 |

|  | VRC03 | VRC-PG04 | VRC-CH31 | 4E10 | 2G12 |  | VRC01 | VRC07 |
|---|---|---|---|---|---|---|---|---|
| # Viruses | 181 | 181 | 181 | 181 | 181 |  | 177 | 181 |
| Total VS Neutralized |  |  |  |  |  |  |  |  |
| IC50 <50ug/ml | 8 | 19 | 21 | 27 | 6 |  | 23 | 25 |
| IC50 <1ug/ml | 3 | 14 | 16 | 8 | 1 |  | 18 | 21 |
| % VS Neutralized |  |  |  |  |  |  |  |  |
| IC50 <50ug/ml | 4 | 10 | 12 | 15 | 3 |  | 13 | 14 |
| IC50 <1ug/ml | 2 | 8 | 9 | 4 | 1 |  | 10 | 12 |
| Median IC50 | 2.015 | 0.187 | 0.355 | 2.06 | 6.97 |  | 0.266 | 0.121 |
| Geometric Mean | 1.340 | 0.302 | 0.366 | 1.73 | 3.28 |  | 0.378 | 0.185 |

FIG. 8A  Protein sequence alignment showing CDRs based on IMGT definition

FIG. 8B  Protein sequence alignment showing CDRs based on Kabat definition

FIG. 8C

VRC01 Light Chain Variable Domain

Kabat (CDRS: 24-32, 48-54, 87-91)

```
         1111111111222222222233333333334444444444555555555566666666667777777777888888888899999999990000000000111
1234567890123456789012345678901234567890123456789012345678901234567890123456789012345678901234567890123
EIVLTQSPGTLSLSPGETAIISCRTSQYGSLAWYQQRFGQAPRLVIYSGSTRAAGIPDRFSGSRWGPDYNLTISNLESGDFGVYYCQQYEFFGQGTKVQVDIK
```

IMGT (CDRS: 27-30, 48-50, 87-91)

```
         1111111111222222222233333333334444444444555555555566666666667777777777888888888899999999990000000000111
1234567890123456789012345678901234567890123456789012345678901234567890123456789012345678901234567890123
EIVLTQSPGTLSLSPGETAIISCRTSQYGSLAWYQQRFGQAPRLVIYSGSTRAAGIPDRFSGSRWGPDYNLTISNLESGDFGVYYCQQYEFFGQGTKVQVDIK
```

FIG. 8D

| Linear sequence | Kabat Numbering | VRC01L A.A. | Linear sequence | Kabat Numbering | VRC07H A.A. |
|---|---|---|---|---|---|
| 1 | 1 | E | 1 | 1 | Q |
| 2 | 2 | I | 2 | 2 | V |
| 3 | 3 | V | 3 | 3 | R |
| 4 | 4 | L | 4 | 4 | L |
| 5 | 5 | T | 5 | 5 | S |
| 6 | 6 | Q | 6 | 6 | Q |
| 7 | 7 | S | 7 | 7 | S |
| 8 | 8 | P | 8 | 8 | G |
| 9 | 9 | G | 9 | 9 | G |
| 10 | 10 | T | 10 | 10 | Q |
| 11 | 11 | L | 11 | 11 | M |
| 12 | 12 | S | 12 | 12 | K |
| 13 | 13 | L | 13 | 13 | K |
| 14 | 14 | S | 14 | 14 | P |
| 15 | 15 | P | 15 | 15 | G |
| 16 | 16 | G | 16 | 16 | D |
| 17 | 17 | E | 17 | 17 | S |
| 18 | 18 | T | 18 | 18 | M |
| 19 | 19 | A | 19 | 19 | R |
| 20 | 20 | I | 20 | 20 | I |
| 21 | 21 | I | 21 | 21 | S |
| 22 | 22 | S | 22 | 22 | C |
| 23 | 23 | C | 23 | 23 | R |
| 24 | 24 | R | 24 | 24 | A |
| 25 | 25 | T | 25 | 25 | S |
| 26 | 26 | S | 26 | 26 | G |
| 27 | 27 | Q | 27 | 27 | Y |
| 28 | 28 | Y | 28 | 28 | E |
| 29 | 29 | G | 29 | 29 | F |
| 30 | 30 | S | 30 | 30 | I |
| 31 | 33 | L | 31 | 31 | N |
| 32 | 34 | A | 32 | 32 | C |
| 33 | 35 | W | 33 | 33 | P |
| 34 | 36 | Y | 34 | 34 | I |
| 35 | 37 | Q | 35 | 35 | N |
| 36 | 38 | Q | 36 | 36 | W |
| 37 | 39 | R | 37 | 37 | I |
| 38 | 40 | P | 38 | 38 | R |
| 39 | 41 | G | 39 | 39 | L |
| 40 | 42 | Q | 40 | 40 | A |
| 41 | 43 | A | 41 | 41 | P |
| 42 | 44 | P | 42 | 42 | G |
| 43 | 45 | R | 43 | 43 | K |
| 44 | 46 | L | 44 | 44 | R |

FIG. 8E

| Linear sequence | Kabat Numbering | VRC01L A.A. | Linear sequence | Kabat Numbering | VRC07H A.A. |
|---|---|---|---|---|---|
| 45 | 47 | V | 45 | 45 | P |
| 46 | 48 | I | 46 | 46 | E |
| 47 | 49 | Y | 47 | 47 | W |
| 48 | 50 | S | 48 | 48 | M |
| 49 | 51 | G | 49 | 49 | G |
| 50 | 52 | S | 50 | 50 | W |
| 51 | 53 | T | 51 | 51 | M |
| 52 | 54 | R | 52 | 52 | K |
| 53 | 55 | A | 53 | 52A | P |
| 54 | 56 | A | 54 | 53 | R |
| 55 | 57 | G | 55 | 54 | G |
| 56 | 58 | I | 56 | 55 | G |
| 57 | 59 | P | 57 | 56 | A |
| 58 | 60 | D | 58 | 57 | V |
| 59 | 61 | R | 59 | 58 | S |
| 56 | 62 | F | 60 | 59 | Y |
| 57 | 63 | S | 61 | 60 | A |
| 58 | 64 | G | 62 | 61 | R |
| 59 | 65 | S | 63 | 62 | Q |
| 60 | 66 | R | 64 | 63 | L |
| 61 | 67 | W | 65 | 64 | Q |
| 62 | 68 | G | 66 | 65 | G |
| 63 | 69 | P | 67 | 66 | R |
| 64 | 70 | D | 68 | 67 | V |
| 65 | 71 | Y | 69 | 68 | T |
| 66 | 72 | N | 70 | 69 | M |
| 67 | 73 | L | 71 | 70 | T |
| 68 | 74 | T | 72 | 71 | R |
| 69 | 75 | I | 73 | 72 | D |
| 70 | 76 | S | 74 | 73 | M |
| 71 | 77 | N | 75 | 74 | Y |
| 72 | 78 | L | 76 | 75 | S |
| 73 | 79 | E | 77 | 76 | E |
| 74 | 80 | S | 78 | 77 | T |
| 75 | 81 | G | 79 | 78 | A |
| 76 | 82 | D | 80 | 79 | F |
| 77 | 83 | F | 81 | 80 | L |
| 78 | 84 | G | 82 | 81 | E |
| 79 | 85 | V | 83 | 82 | L |
| 80 | 86 | Y | 84 | 82A | R |
| 81 | 87 | Y | 85 | 82B | S |
| 82 | 88 | C | 86 | 82C | L |
| 83 | 89 | Q | 87 | 83 | T |
| 84 | 90 | Q | 88 | 84 | S |

FIG. 8F

| Linear sequence | Kabat Numbering | VRC01L A.A. | Linear sequence | Kabat Numbering | VRC07H A.A. |
|---|---|---|---|---|---|
| 85 | 91 | Y | 89 | 85 | D |
| 86 | 92 | E | 90 | 86 | D |
| 87 | 93 | F | 91 | 87 | T |
| 88 | 94 | F | 92 | 88 | A |
| 89 | 95 | G | 93 | 89 | V |
| 90 | 96 | Q | 94 | 90 | Y |
| 91 | 97 | G | 95 | 91 | F |
| 92 | 98 | T | 96 | 92 | C |
| 93 | 99 | K | 97 | 93 | T |
| 94 | 100 | V | 98 | 94 | R |
| 95 | 101 | Q | 99 | 95 | G |
| 96 | 102 | V | 100 | 96 | K |
| 97 | 103 | D | 101 | 97 | Y |
| 98 | 104 | I | 102 | 98 | C |
| 99 | 105 | K | 103 | 99 | T |
|  |  |  | 104 | 100 | A |
|  |  |  | 105 | 100A | R |
|  |  |  | 106 | 100B | D |
|  |  |  | 107 | 100C | Y |
|  |  |  | 108 | 100D | Y |
|  |  |  | 109 | 100E | N |
|  |  |  | 110 | 100F | W |
|  |  |  | 111 | 100G | D |
|  |  |  | 112 | 100H | F |
|  |  |  | 113 | 101 | E |
|  |  |  | 114 | 102 | H |
|  |  |  | 115 | 103 | W |
|  |  |  | 116 | 104 | G |
|  |  |  | 117 | 105 | Q |
|  |  |  | 118 | 106 | G |
|  |  |  | 119 | 107 | T |
|  |  |  | 120 | 108 | P |
|  |  |  | 121 | 109 | V |
|  |  |  | 122 | 110 | T |
|  |  |  | 123 | 111 | V |
|  |  |  | 124 | 112 | S |
|  |  |  | 125 | 113 | S |

FIG. 9

Optimization to VRC07H/VRC01L

Fab portion

Structure-based design with structures of VRC07 with mutants at G54 to L, F, R, W and Y was used to guide design.

1. VRC07H: 130Q, G54W, and S58N all improve neutralization
2. Reductions in affinity maturation were also tested (these generally decrease neutralization potency)
3. VRC01L: N72A — removes a site of glycosylation and improves half-life

Fc portion

A number of different published mutations change interaction with effector functions and also control antibody half-life Crystal structures of VRC07 and its mutants Y1.1  VRC07H(G54W, I30Q)
Y1.2  VRC07H(G54W, G56F)
Y1.3  VRC07H (G54W, S58N)
Y1.4  VRC134H (R71)

Y1.1  VRC07H(G54W, I30Q)
Y1.2  VRC07H(G54W, G56F)
Y1.3  VRC07H (G54W, S58N)
Y1.4  VRC134H (R71)

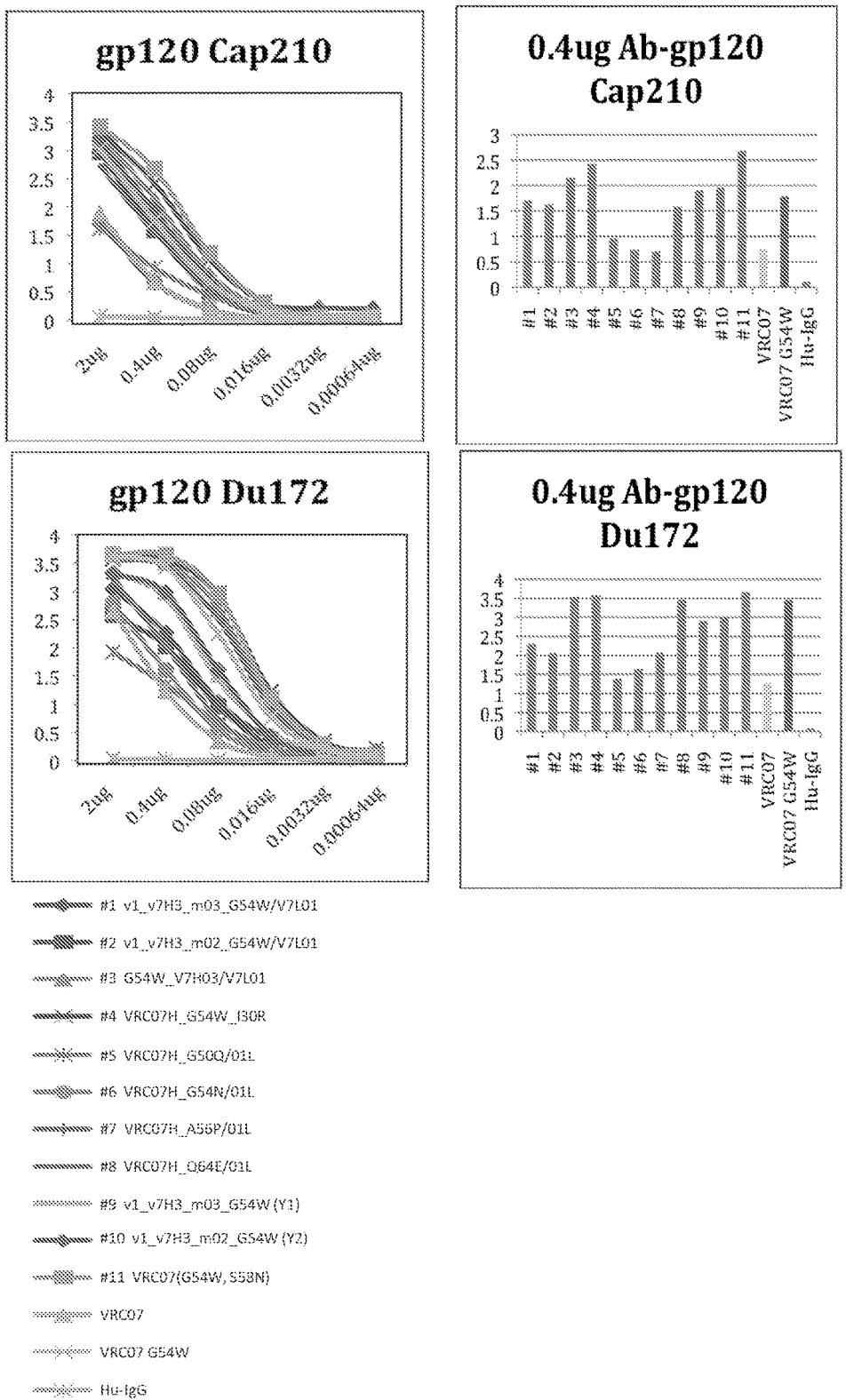

FIG. 14

Study Name: VRC07 Variant & Combinational Abs
Project Code: CVL0923
Assay: Luc/TZM-bl
Values represent mAb concentration required to achieve 50% or 80% neutralization.

Green: IC50 or IC80 < 1 µg/ml
Yellow: IC50 or IC80 between 1 and 10 µg/ml
Brown: IC80 > 10 µg/ml

IC50

| clade | sample Alt ID | VRC07H(G54W) | v1_v7h3_m03_G54W Y1 | v1_v7h3_m02_G54W Y2 | VRC07H(G54W) | VRC07H(G5 4W,I30Q) Y1.1 | VRC07H(G5 4W,I30R) #4 | VRC07H(G5 4W,I53N) Y1.3 |
|---|---|---|---|---|---|---|---|---|
| expt date | | 3/22/11 | 3/22/11 | 3/22/11 | 3/22/11 | 3/22/11 | 3/22/11 | 3/22/11 |
| A | Q23.17.SG3 UG037.8.SG3 | | | | | | | |
| B | 7165.18.SG3 AC10.29.SG3 | 1.09 | 1.02 | 1.27 | 1.08 | | 1.19 | 1.3 |
| C | TV1.29.SG3 ZM53.12.SG3 | | 1.2 | | | | | |
| D | 57128.vrc15.SG3 | | | | | | | |
| non HIV | SIVmac251.30.SIV | >50 | >50 | >50 | >50 | >50 | >50 | >50 |
| geometric mean | | 0.190236522 | 0.1198302 | 0.1287369 | 0.1454227 | | | |
| Fold improvement over G54W | | 1 | 1.587511 | 1.477136 | 1.308159 | | | |

| clade | sample Alt ID | VRC07H(G54W) | v1_v7h3_m03_G54W Y1 | v1_v7h3_m02_G54W Y2 | VRC07H(G54W) | VRC07H(G5 4W,I30Q) Y1.1 | VRC07H(G5 4W,I30R) #4 | VRC07H(G5 4W,I58N) Y1.3 |
|---|---|---|---|---|---|---|---|---|
| expt date | | 2/28/11 | 3/22/11 | 2/22/11 | 2/28/11 | 3/22/11 | 2/28/11 | 2/28/11 |
| A | Q23.17.SG3 UG037.8.SG3 | | | | | | | |
| B | 7165.18.SG3 AC10.29.SG3 | 5.08 | 4.93 | 6.62 | 6.58 | 5.28 | 5.03 | |
| C | TV1.29.SG3 ZM53.12.SG3 | 1.23 | 1.11 | 6.55 | 1.41 | 1.33 | | |
| D | 57128.vrc15.SG3 | 2.6 | 6.15 | 1.28 | | | 3.66 | 2.84 |
| | | | 1.31 | 1.39 | 3.63 | 3.32 | | |
| | | | 1.01 | | | | | |
| non HIV | SIVmac251.30.SIV | >50 | >50 | >50 | >50 | >50 | >50 | >50 |
| geometric mean | | 0.823458896 | | | 1.4197259 | 0.5800126 | 0.6389709 | 0.5879134 |
| Fold improvement over G54W | | 1 | | | 1.287268 | 1.806467 | | |

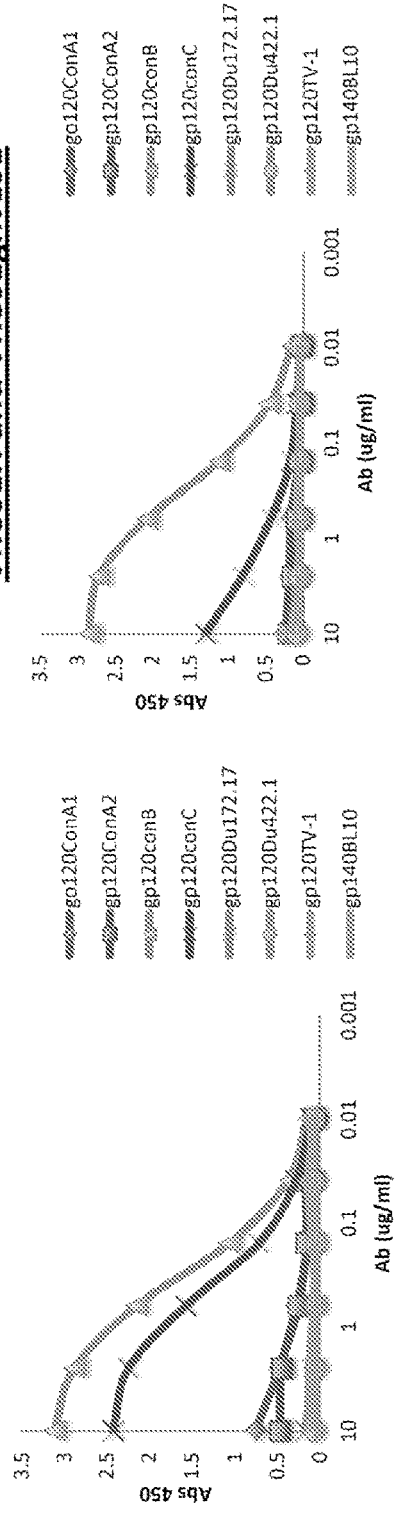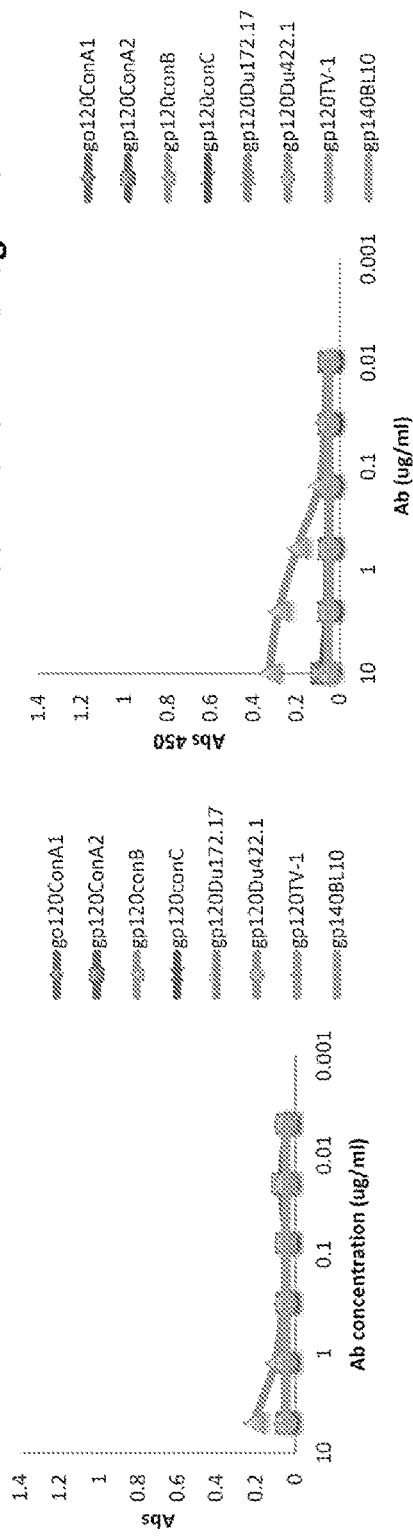
FIG. 15A VRC01-H with various light chains

FIG. 15B
VRC01-H with various light chains
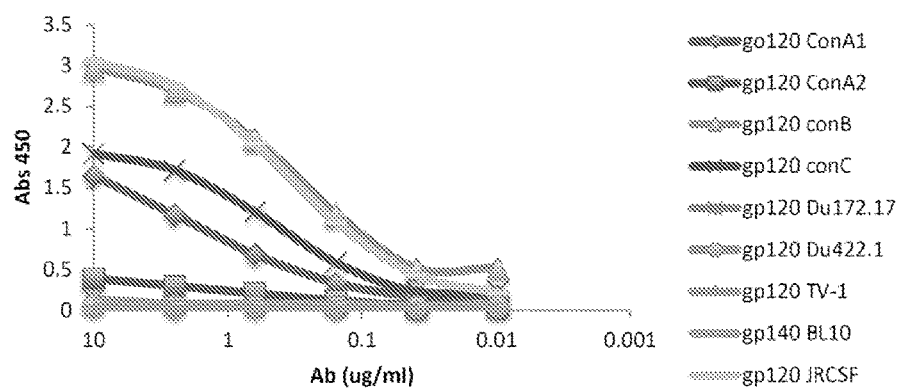
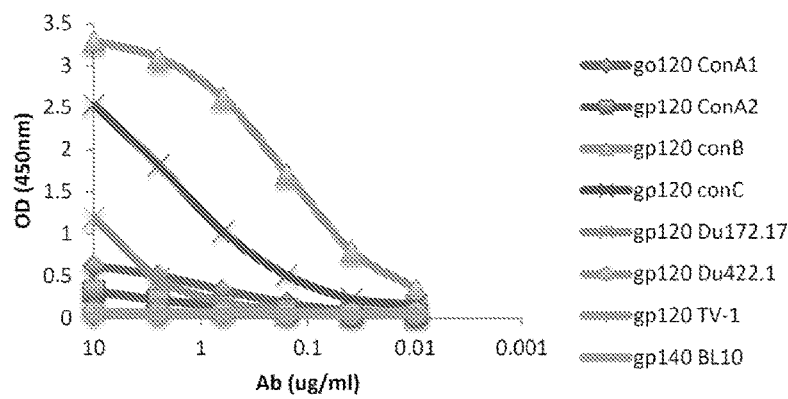

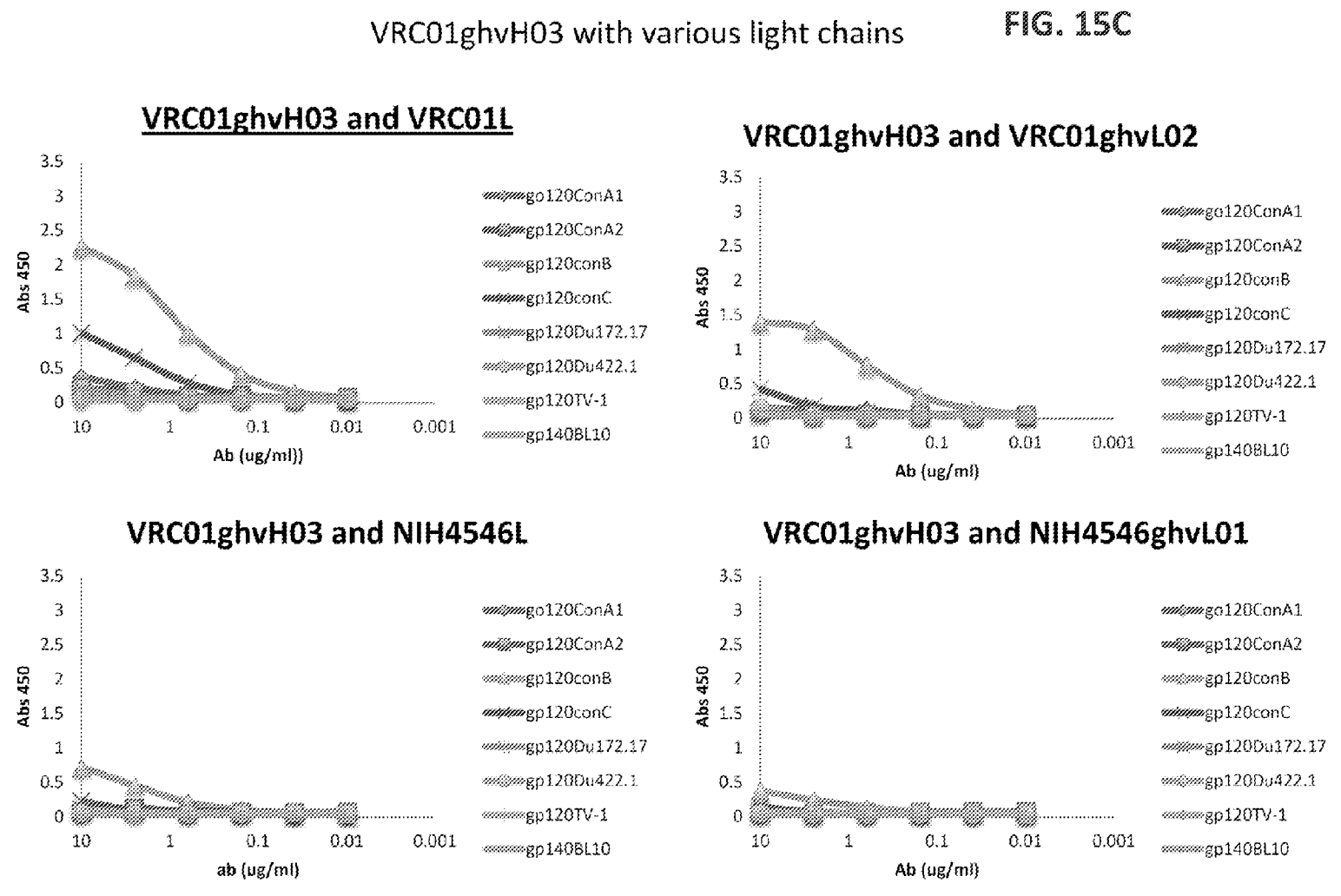

VRC01ghvH03 with various light chains    FIG. 15C

FIG. 15D
VRC01ghvH03 with various light chains
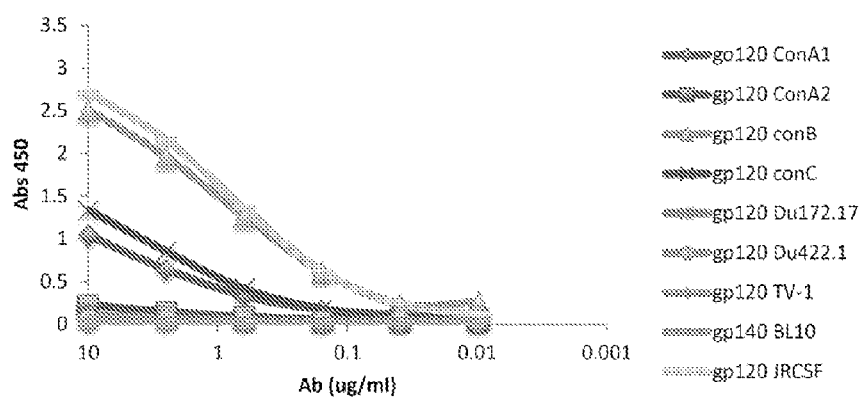
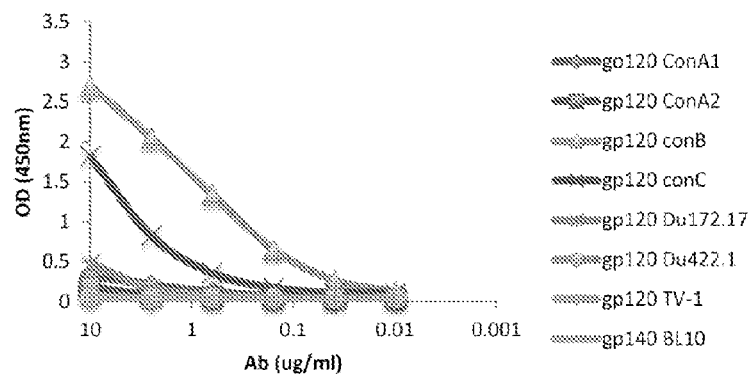

NIH4546-H with various light chains    FIG. 15E
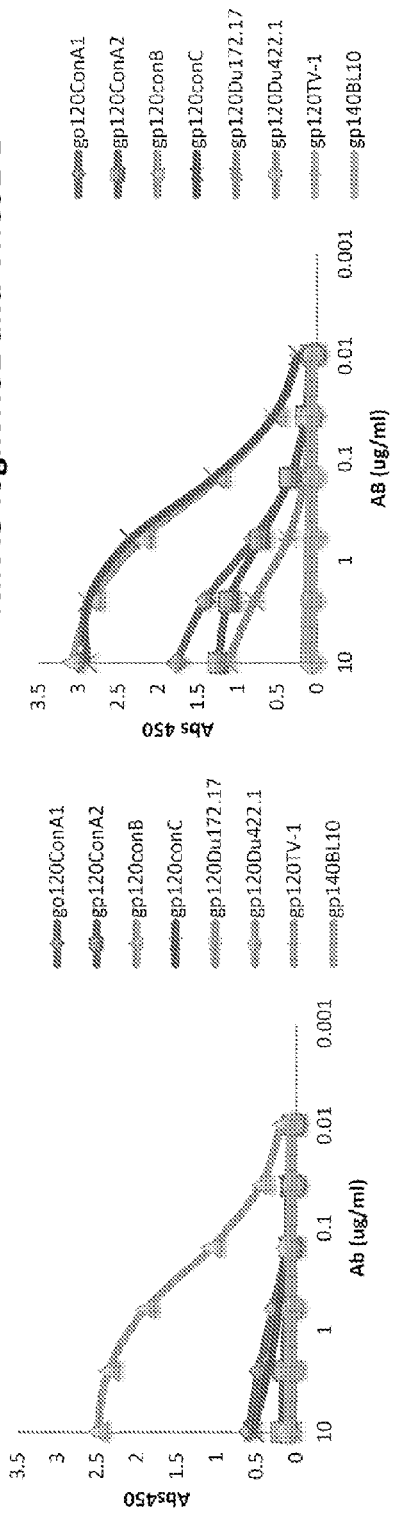
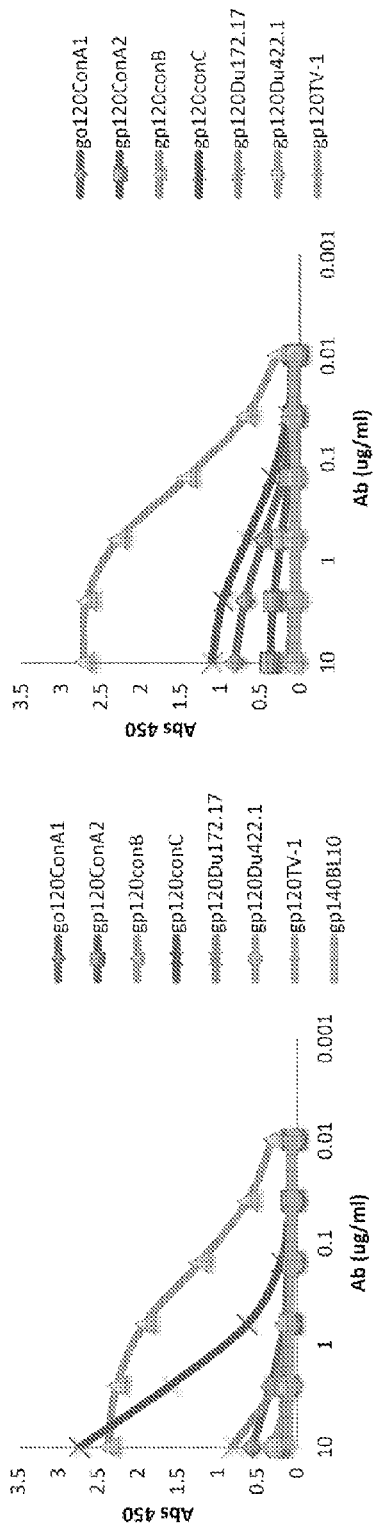

FIG. 15F
NIH4546-H with various light chains
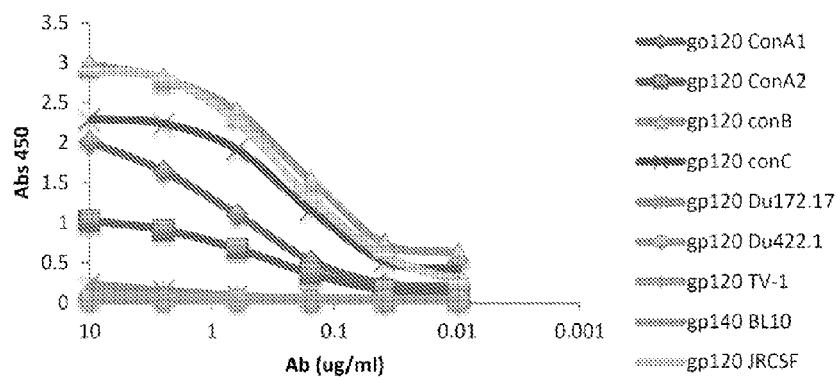
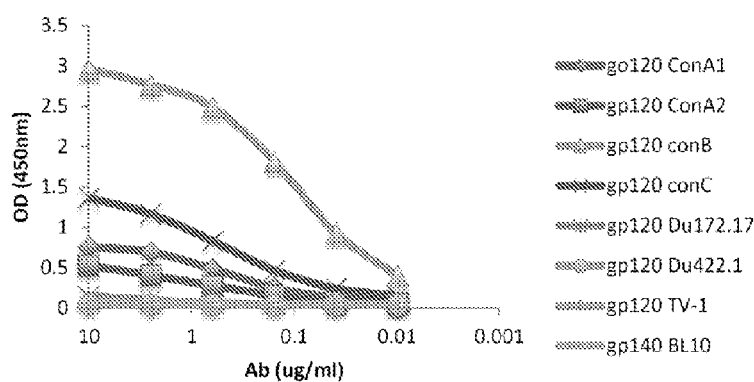

NIH4546ghvH01 with various light chains    FIG. 15G
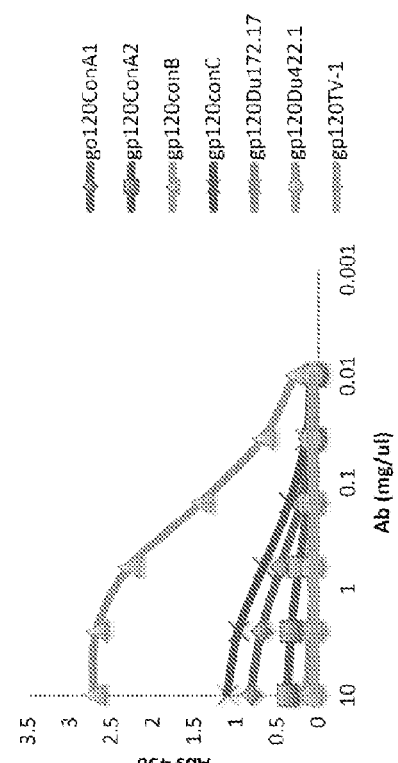
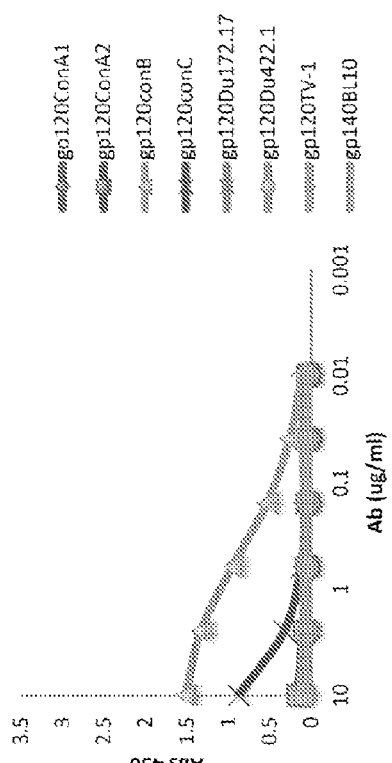
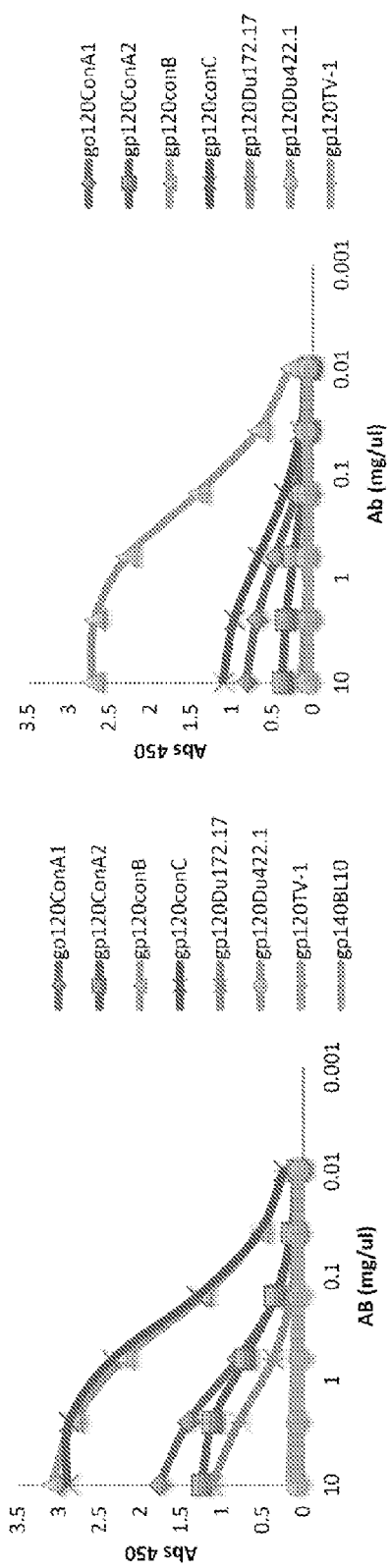
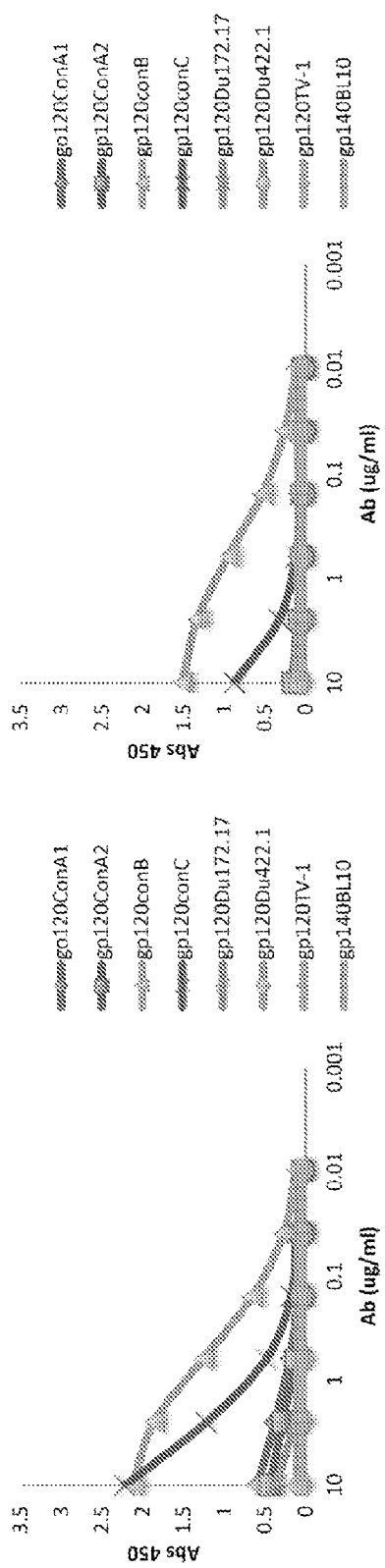

FIG. 15H
NIH4546ghvH01 with various light chains
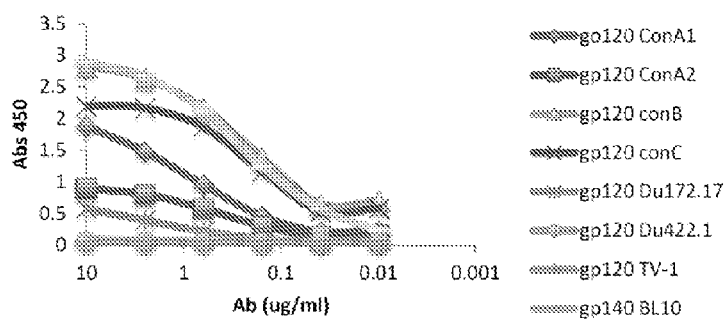
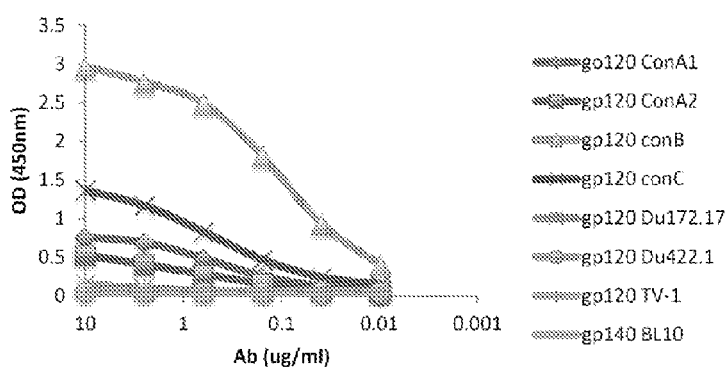

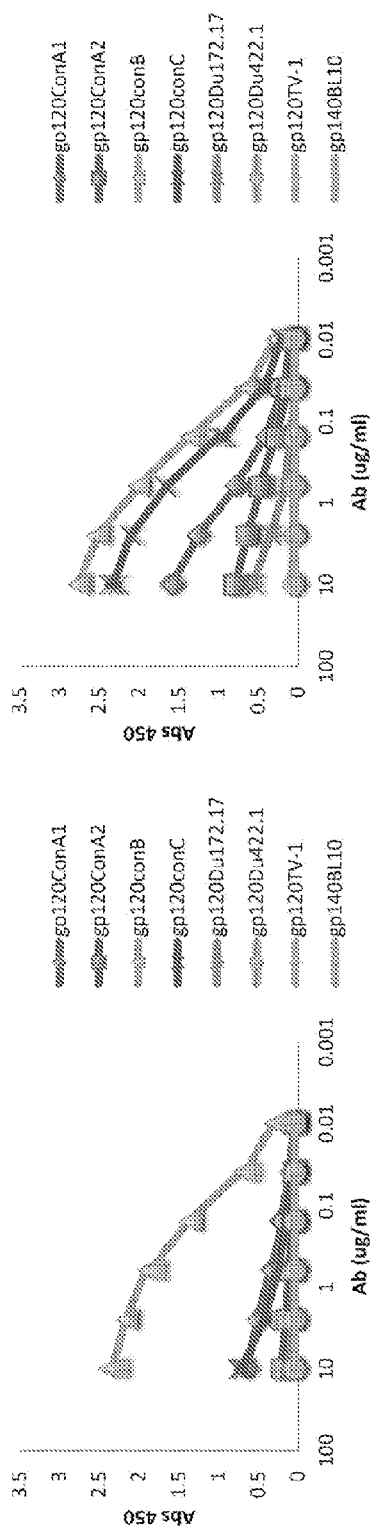
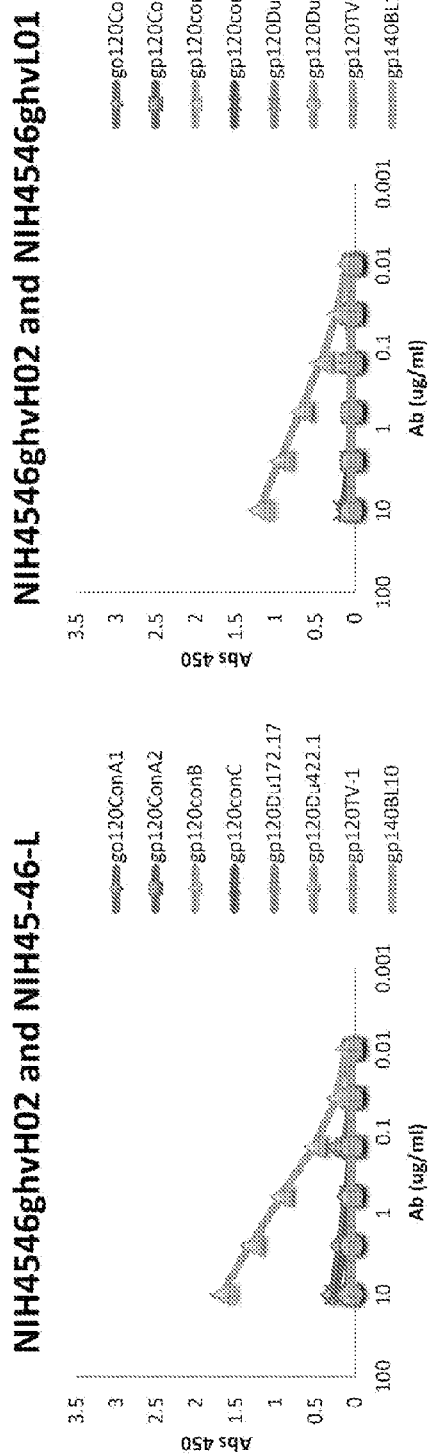
FIG. 15I NIH4546ghvH02 with various light chains

FIG. 15J
NIH4546ghvH02 with various light chains
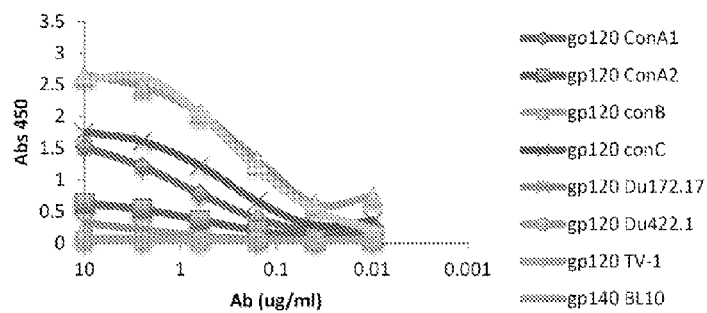
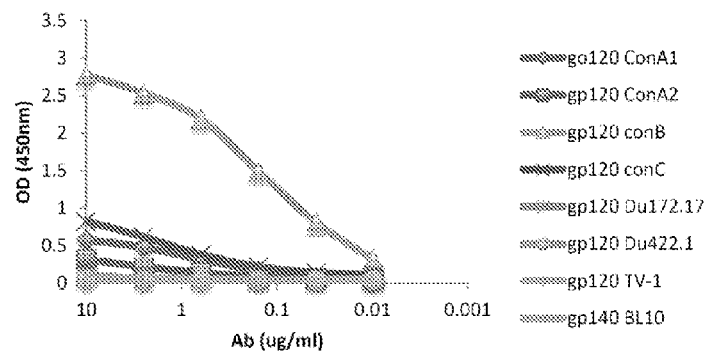

FIG. 15K

FIG. 15L
VRC07-H with various light chains
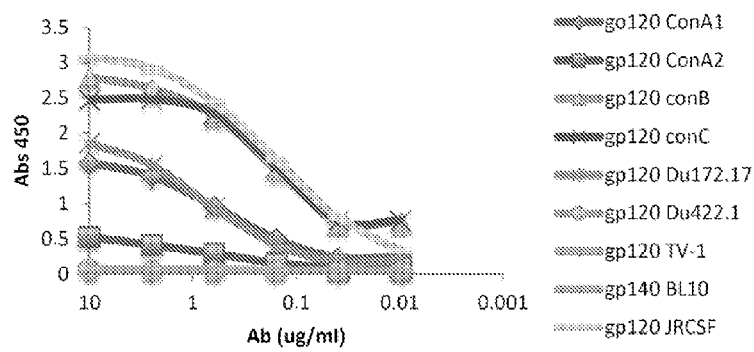
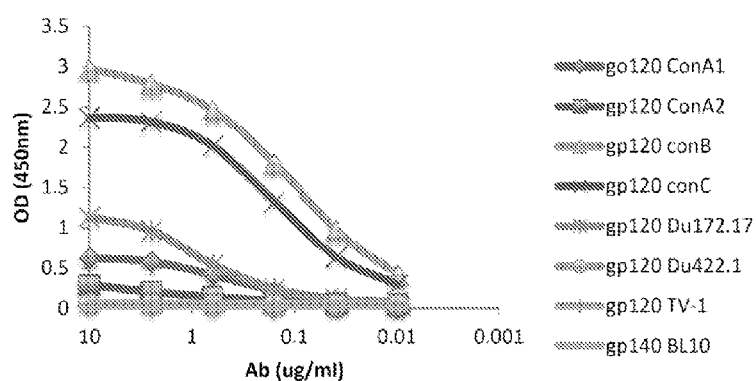

FIG. 15N
VRC07ghvH01 with various light chains
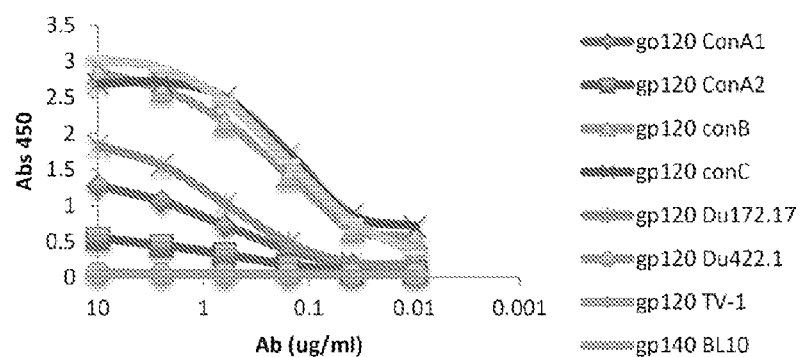
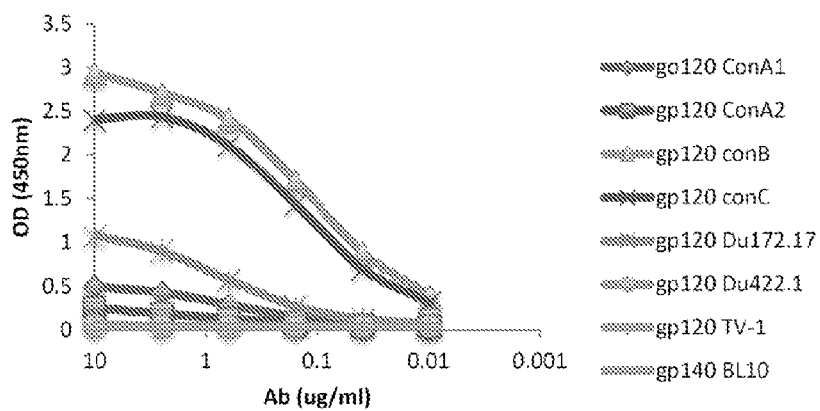

FIG. 15O
VRC07ghvH01 with various light chains
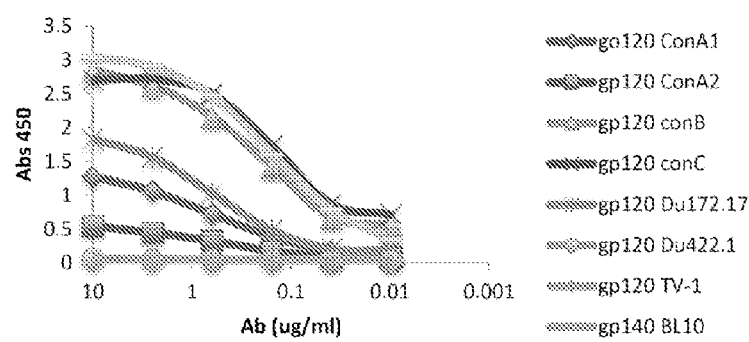
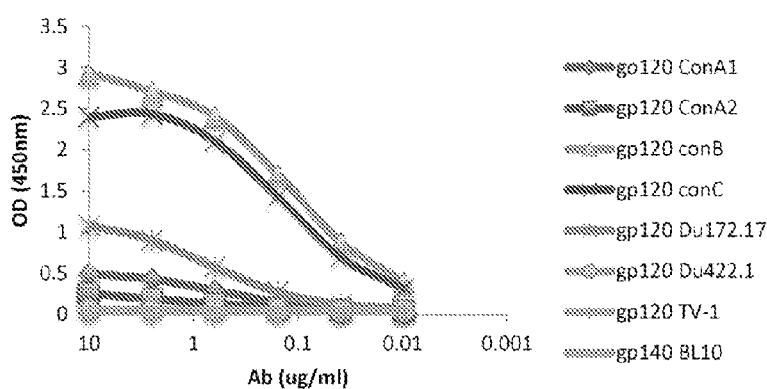

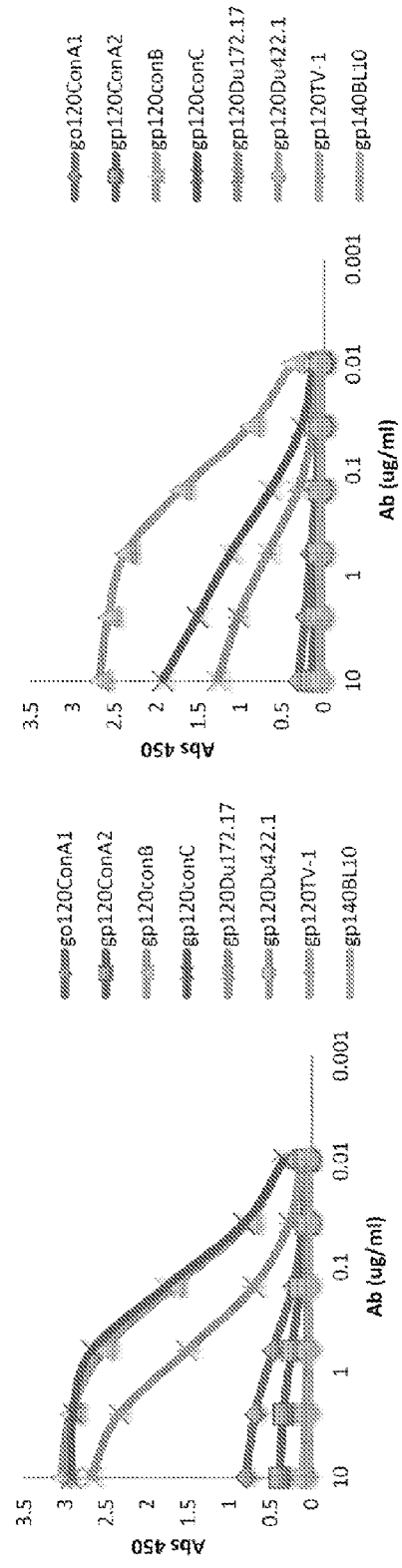
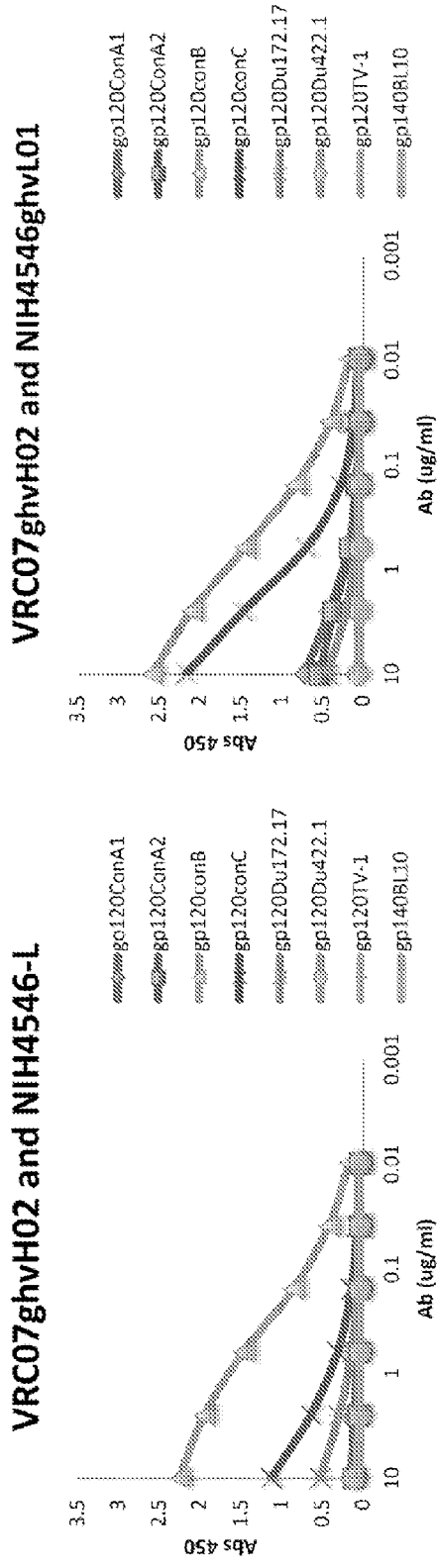
FIG. 15P

FIG. 15Q
VRC07ghvH02 with various light chains
VRC01ghvH02 and VRC01L-N72T
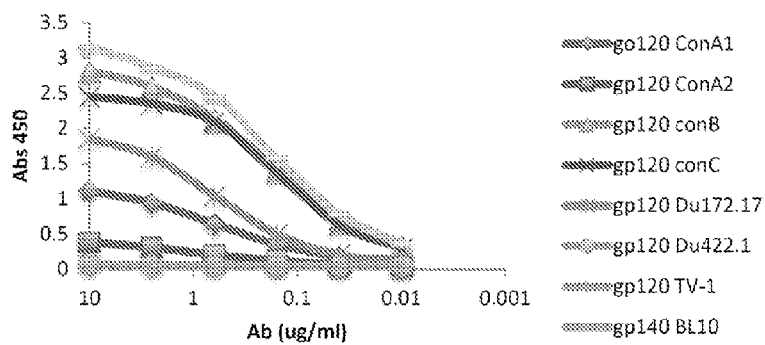
VRC01ghvH02 and VRC01glvL04
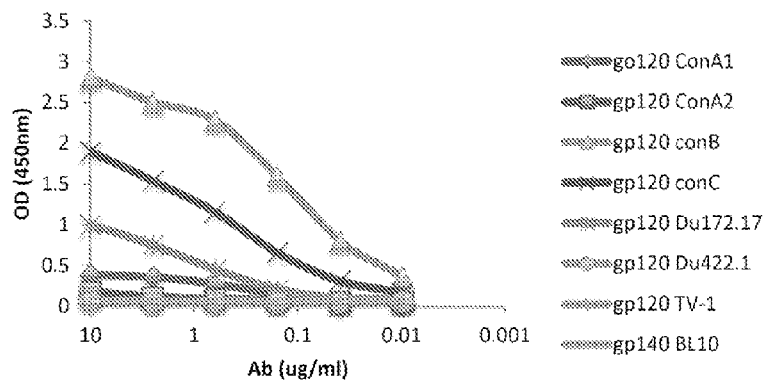

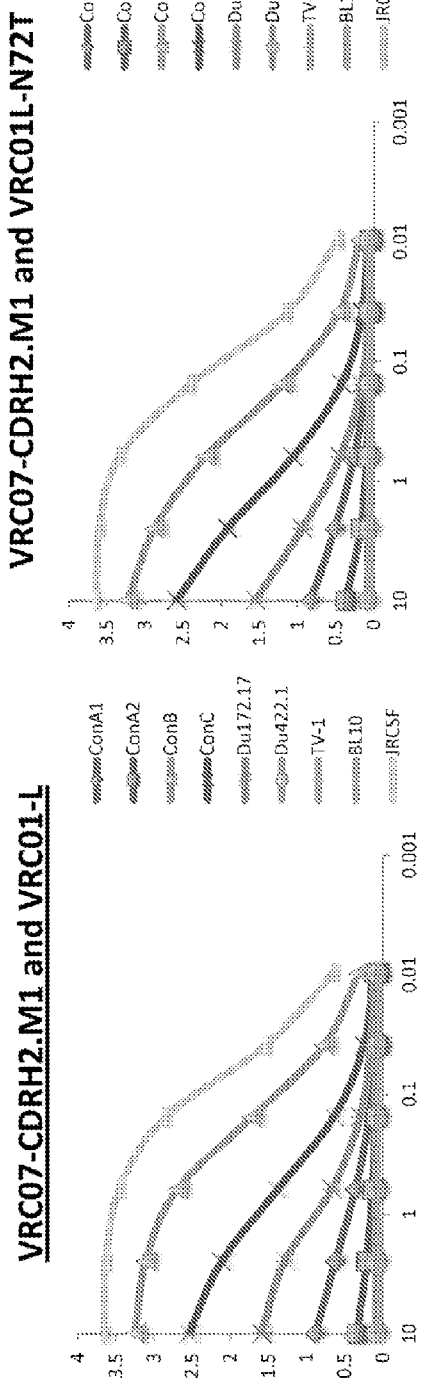
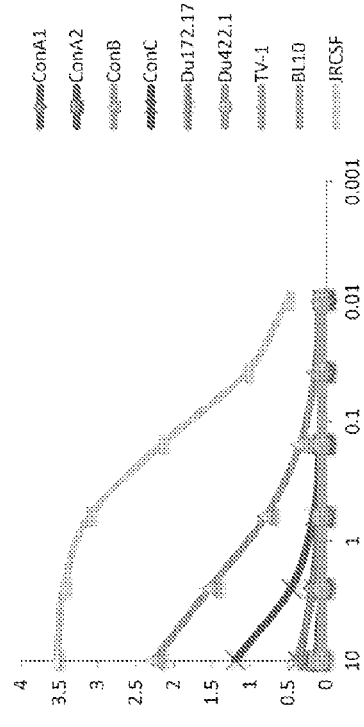
FIG. 15R

FIG. 15S

VRC07ghvH04.1 with various light chains FIG. 15T
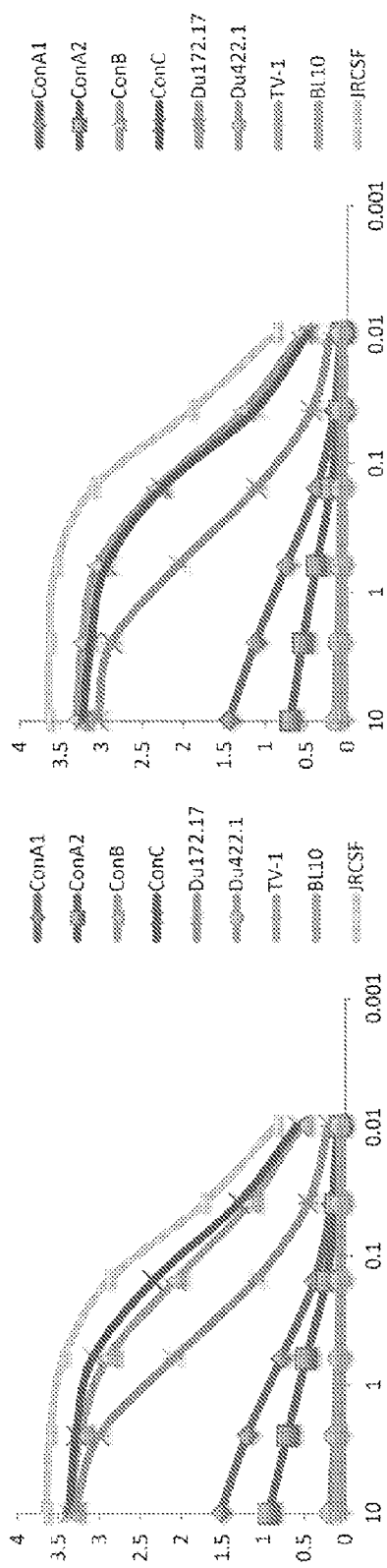
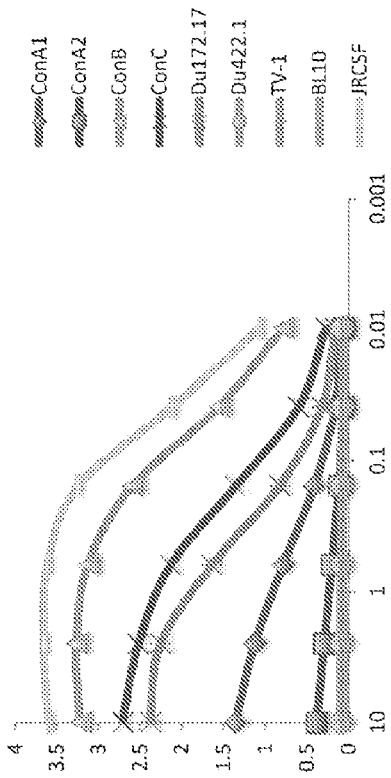

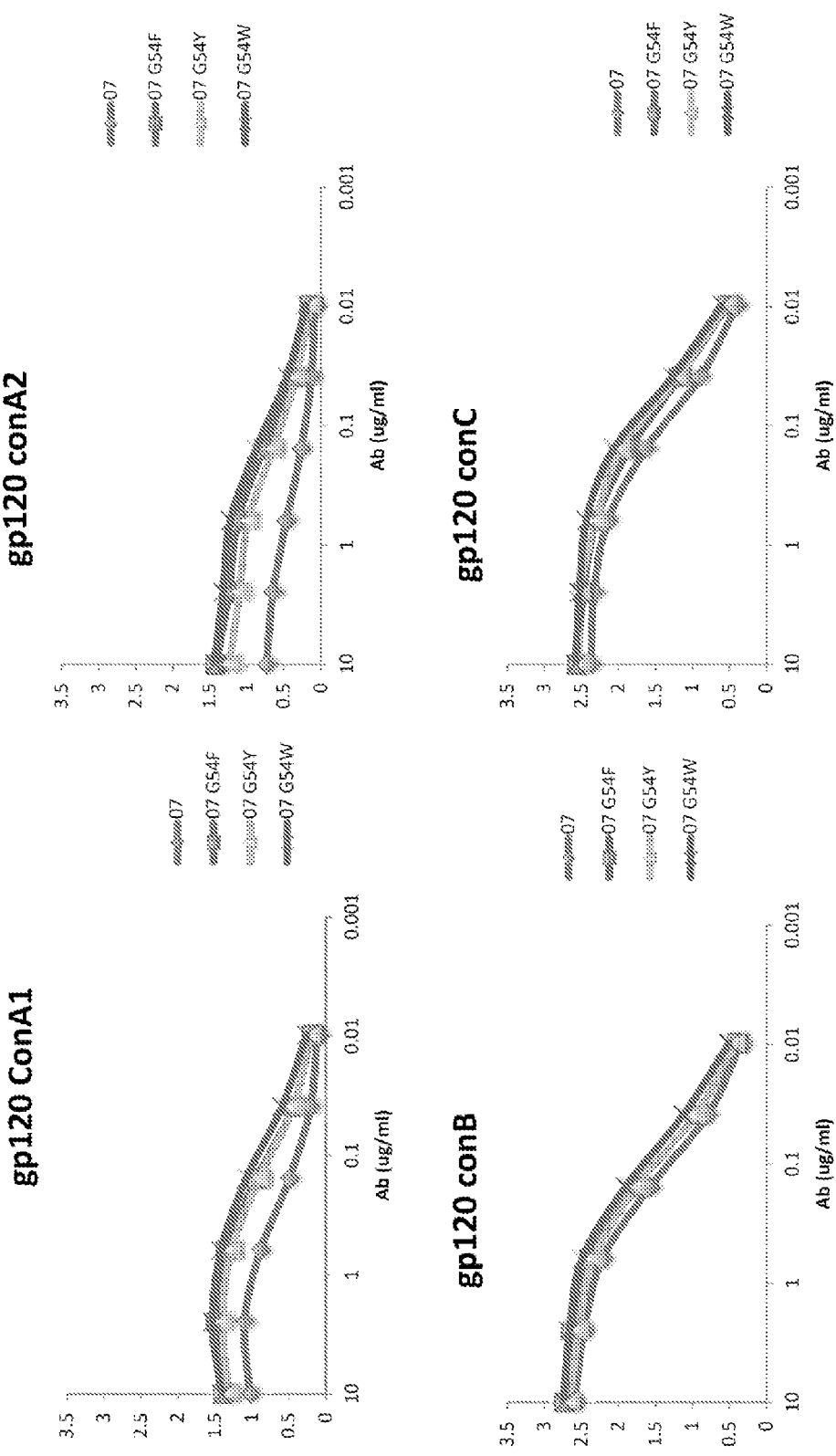

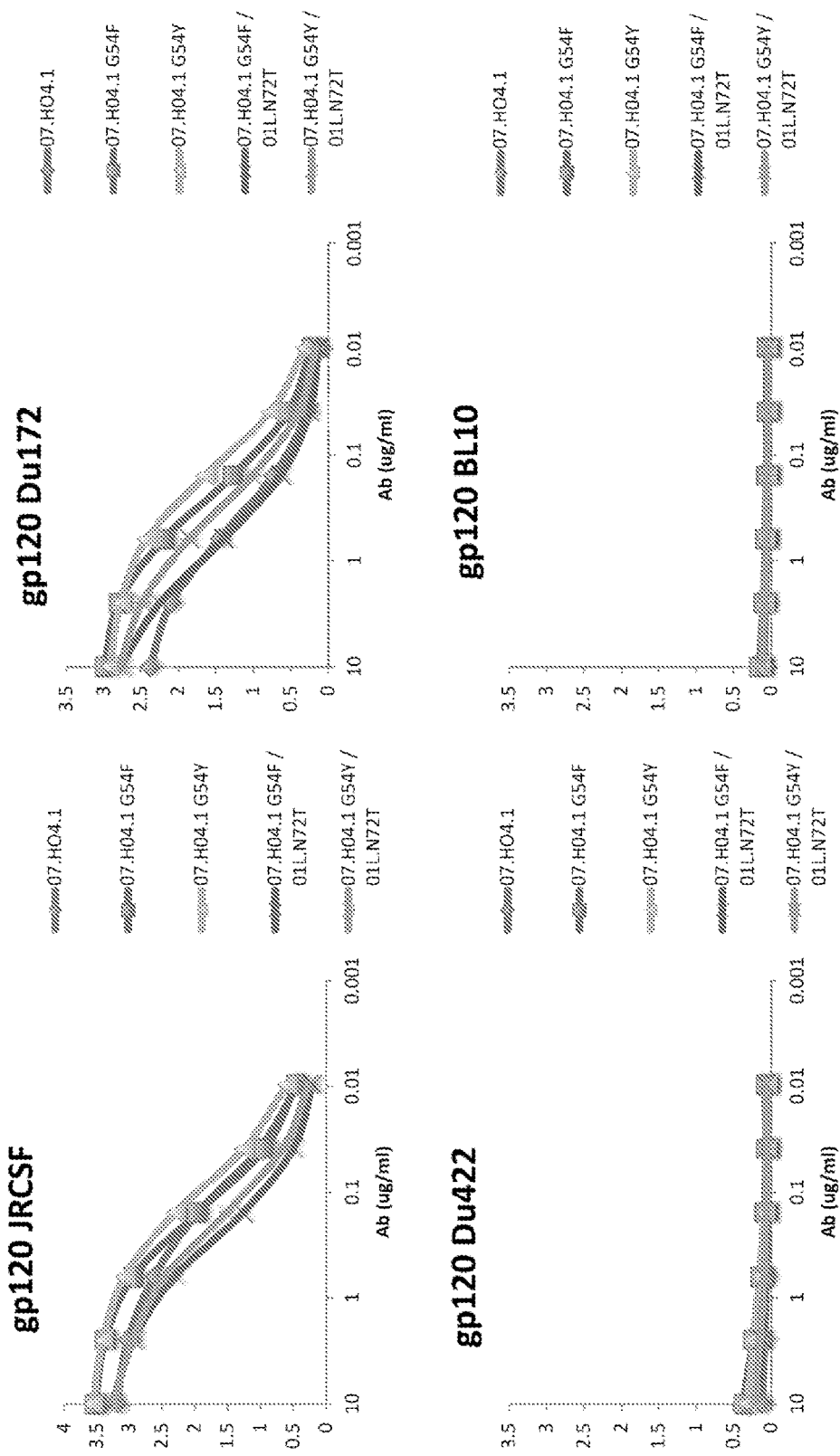

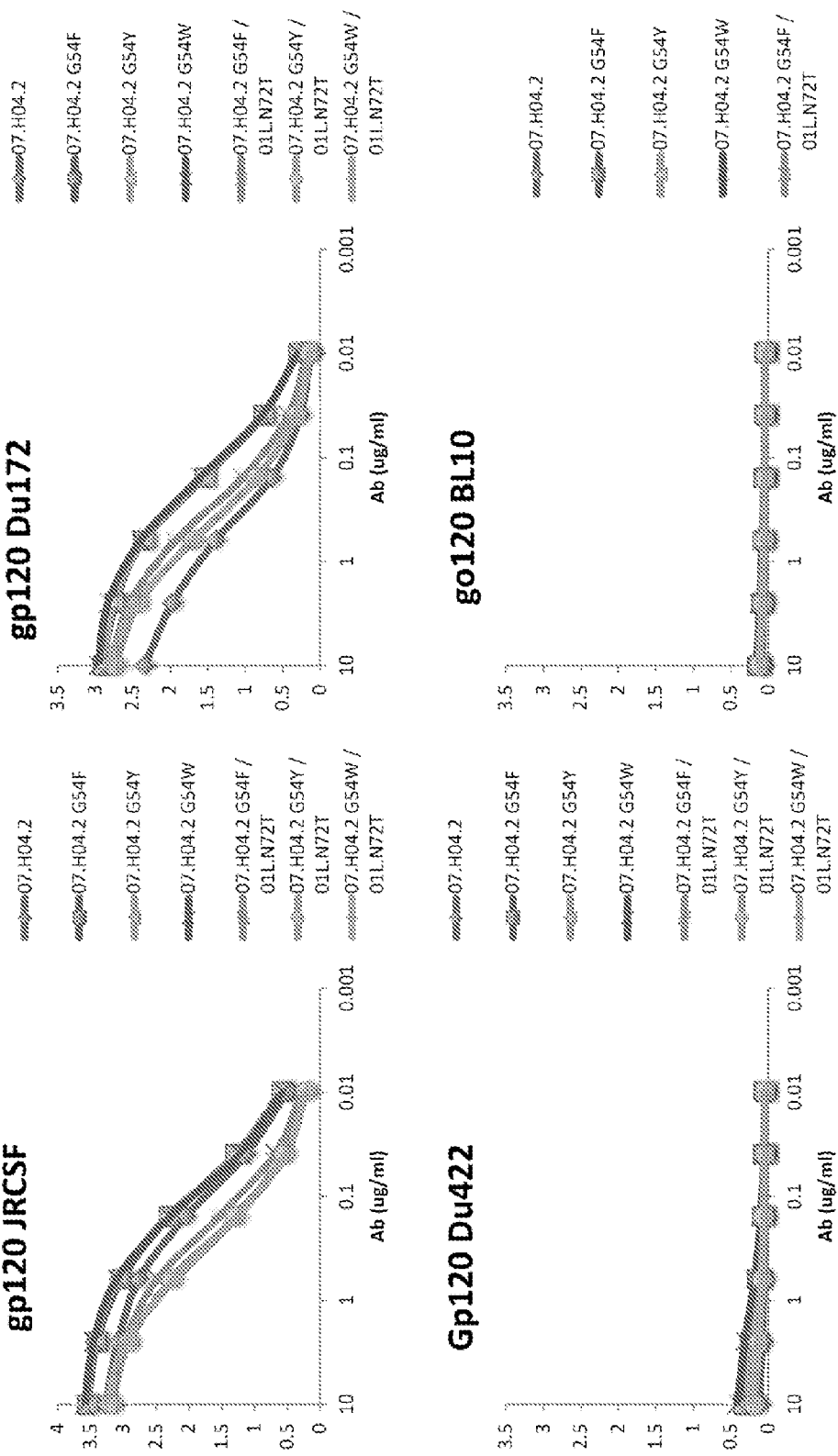

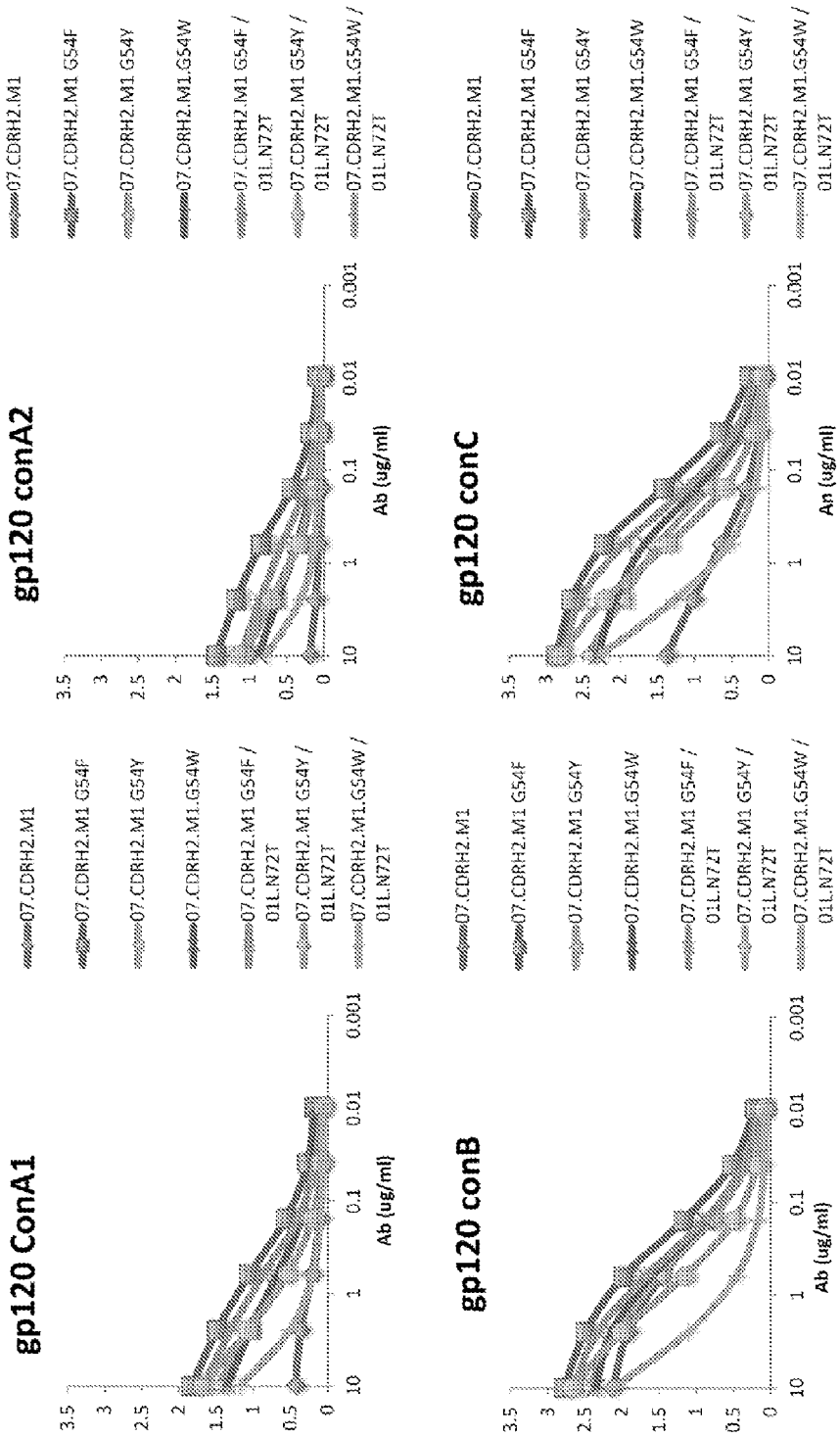

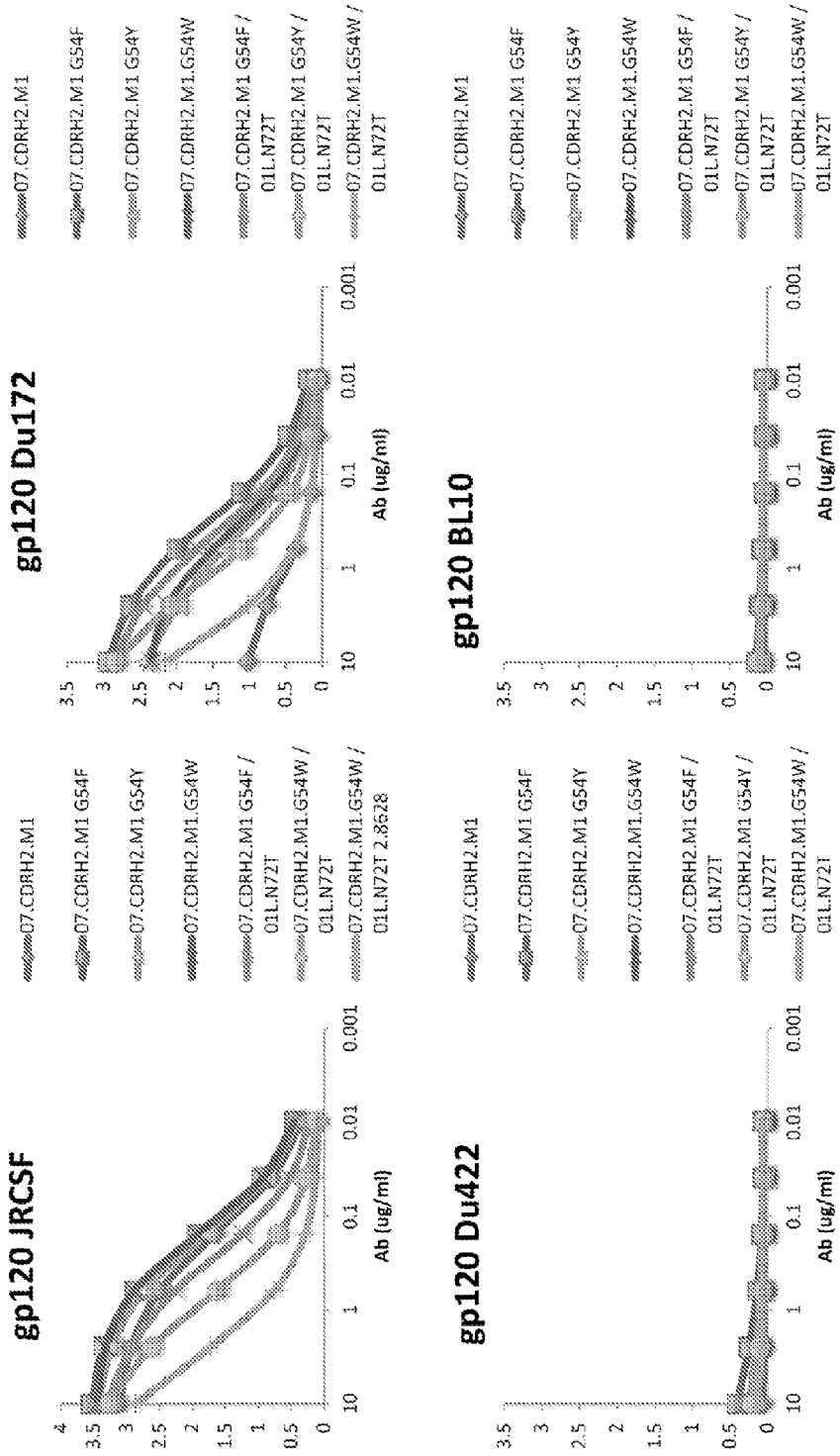

FIG. 15EE

VRC01-L with mutation to knock out an N-liked glycosylation site. All paired with VRC07 G54W Heavy chain.

VRC01-L with mutation to knock out an N-liked glycosylation site.
All pa

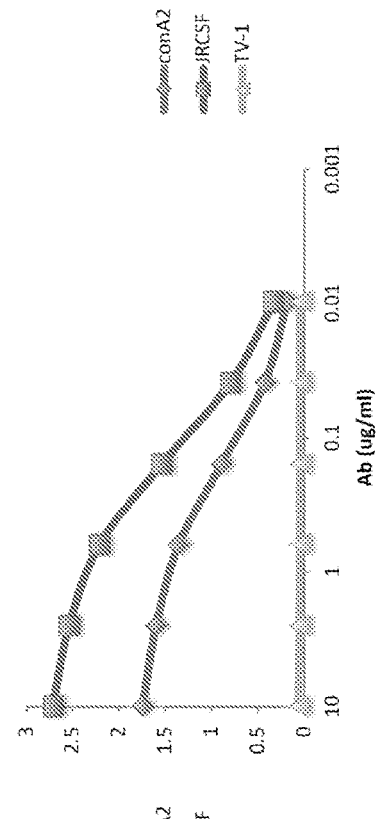
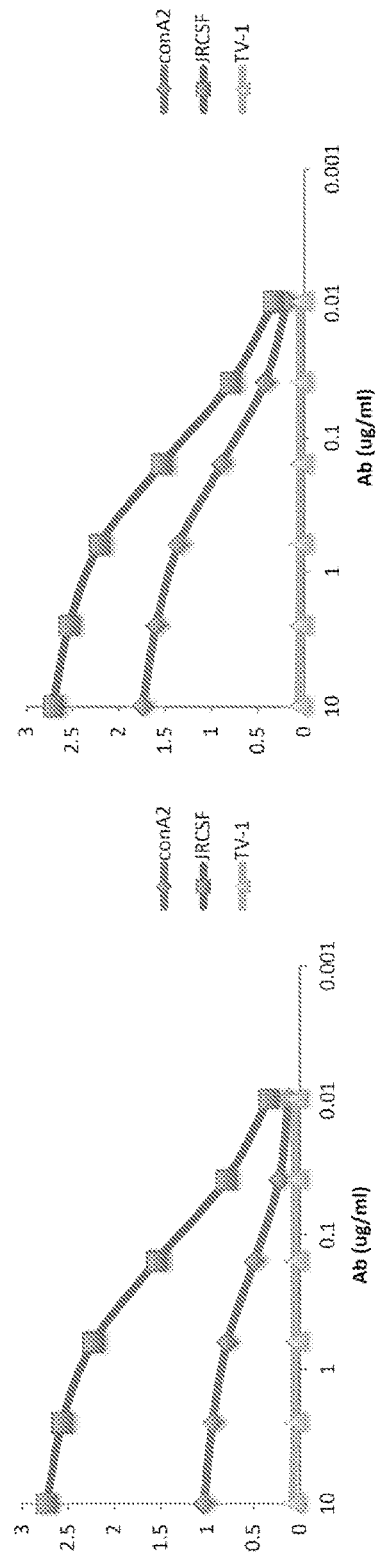
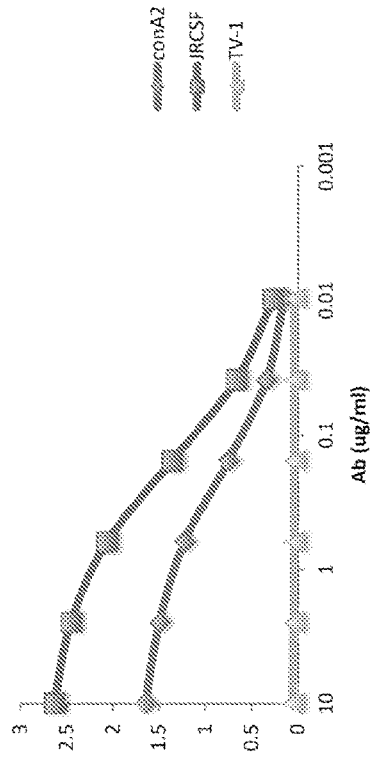
FIG. 15GG

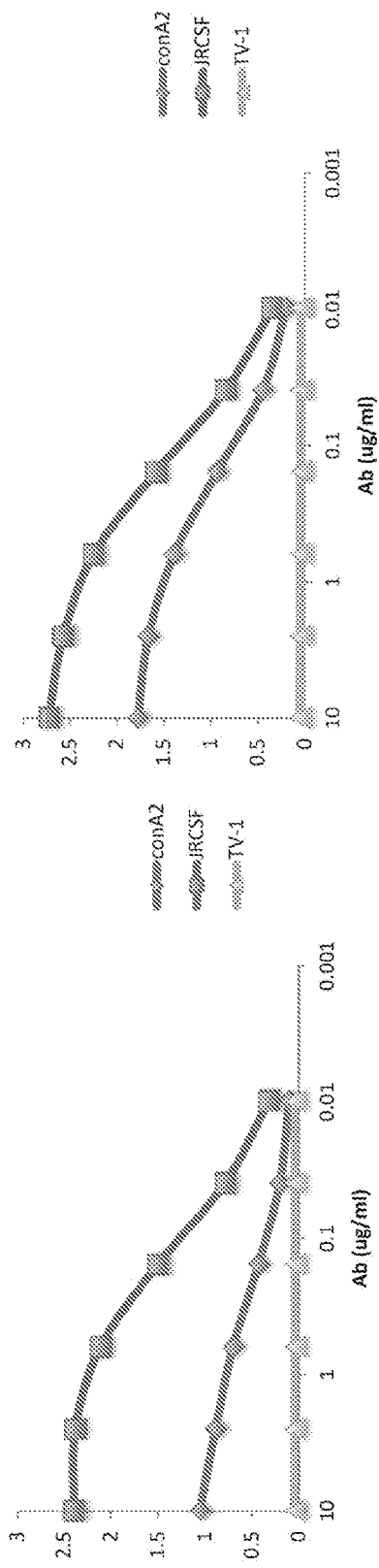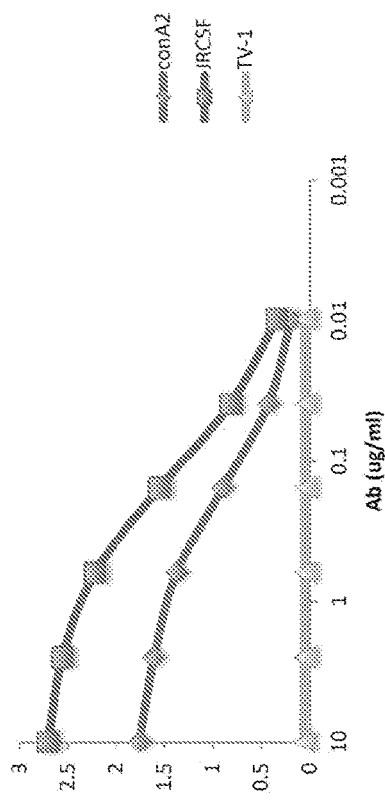
FIG. 15HH

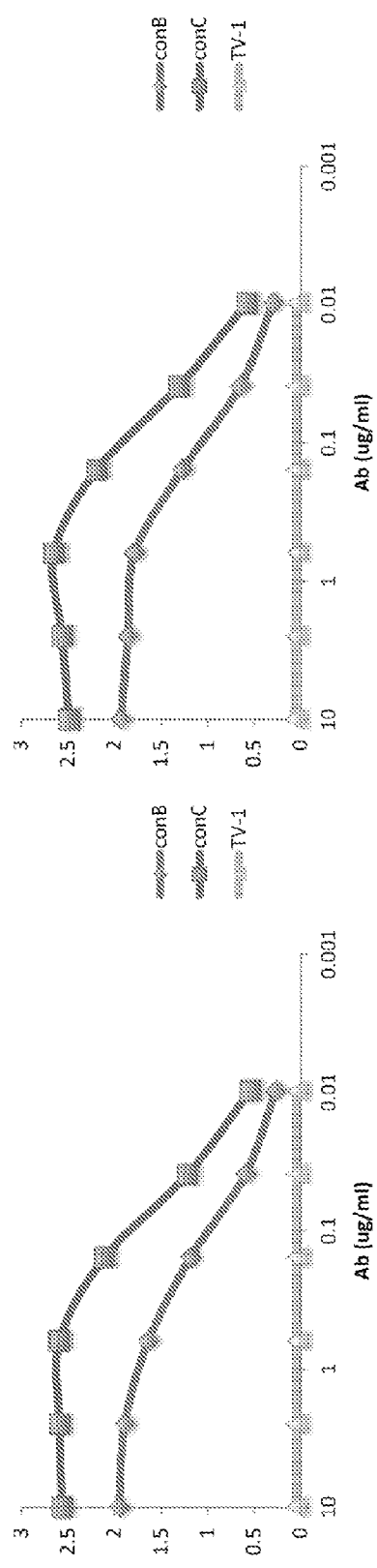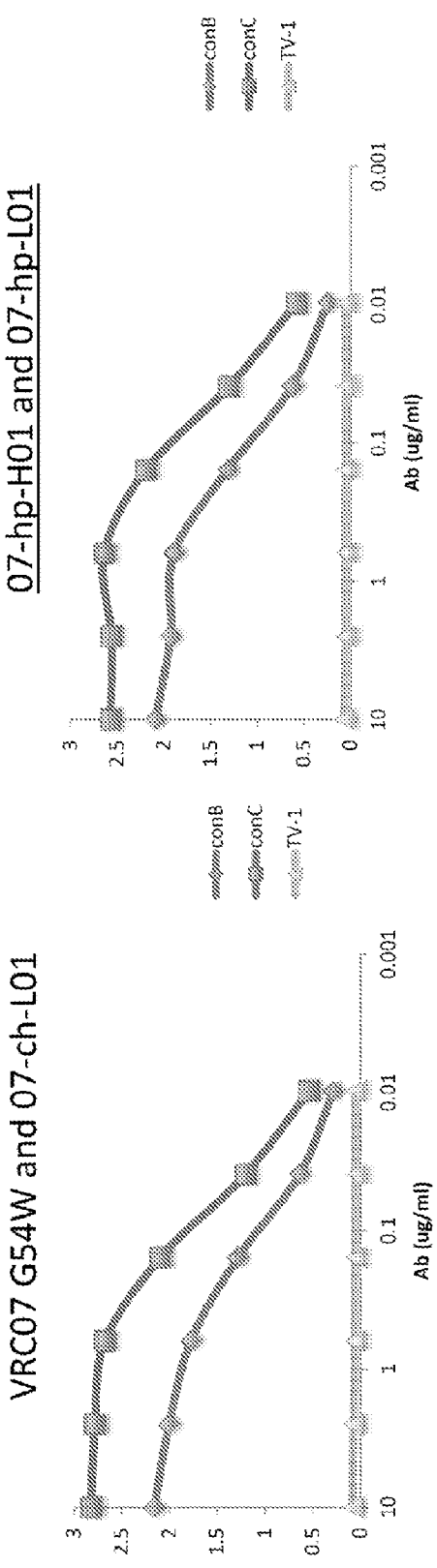
FIG. 15III VRC07H G54W/VRC01L N72T solubility mutants

VRC07H G54W/VRC01L N72T solubility mutants

VRC07ghvH05 and VRC01ghvL05 partial germline reversions  FIG. 15KK
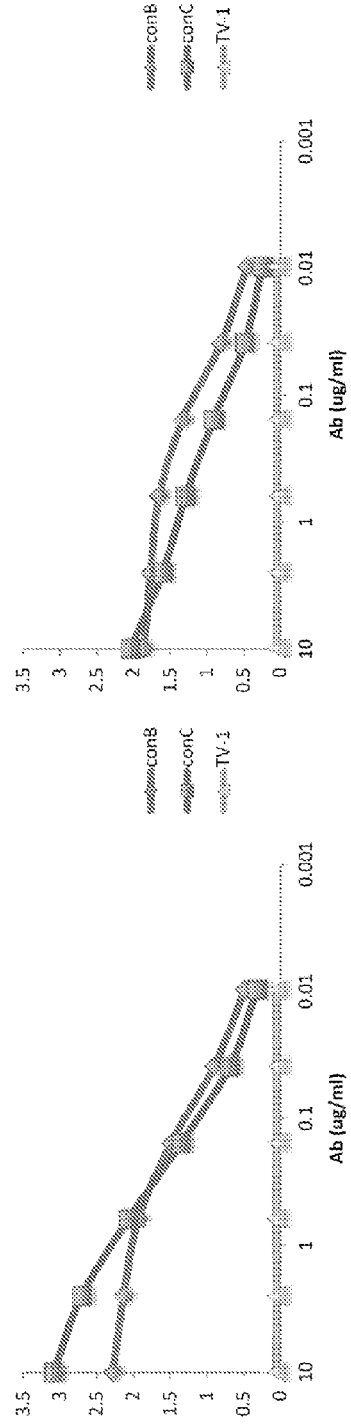
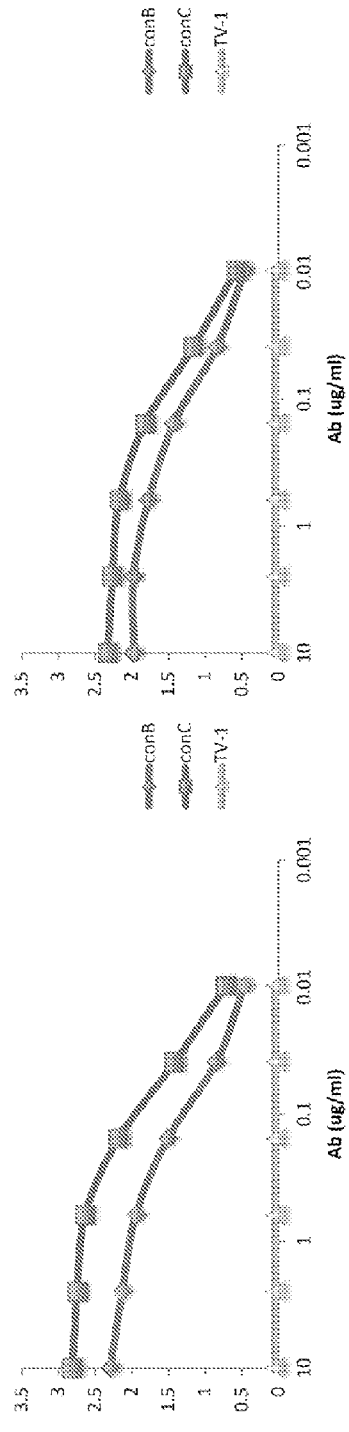

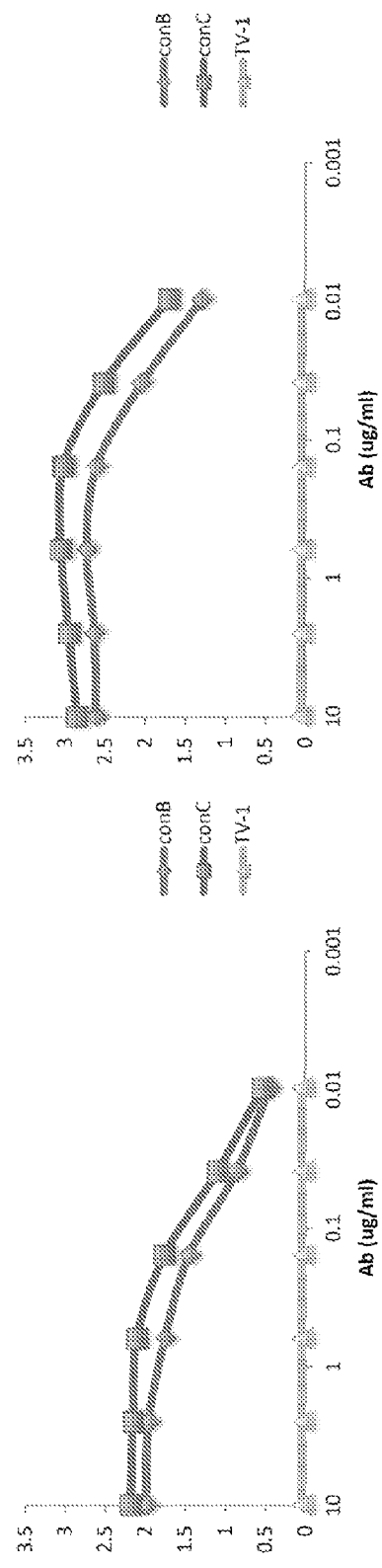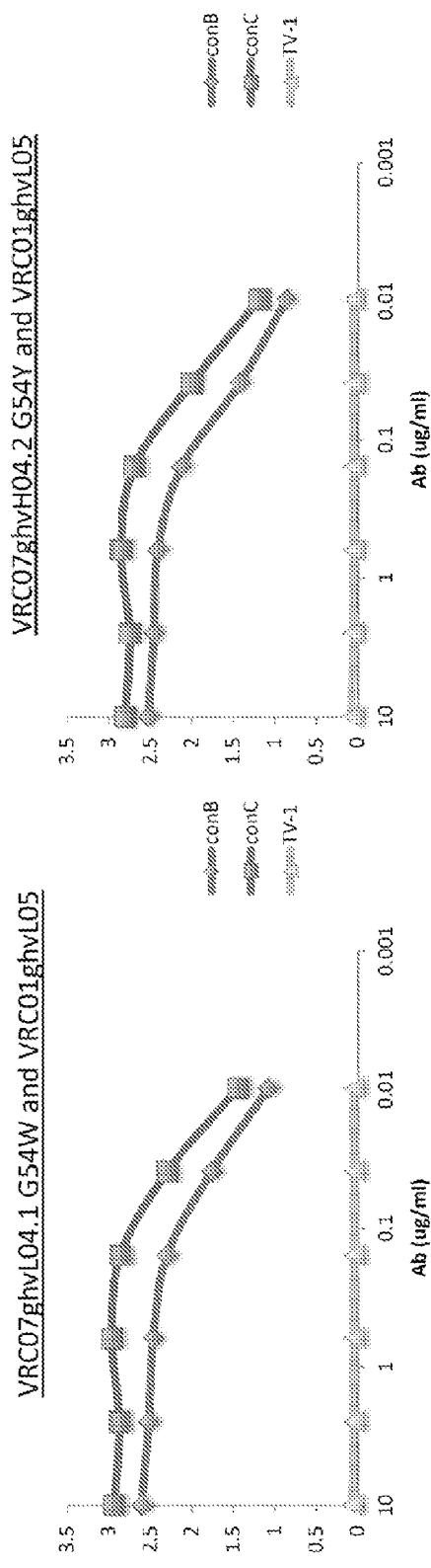
FIG. 15LL
VRC07ghvH05 and VRC01ghvL05 partial germline reversions

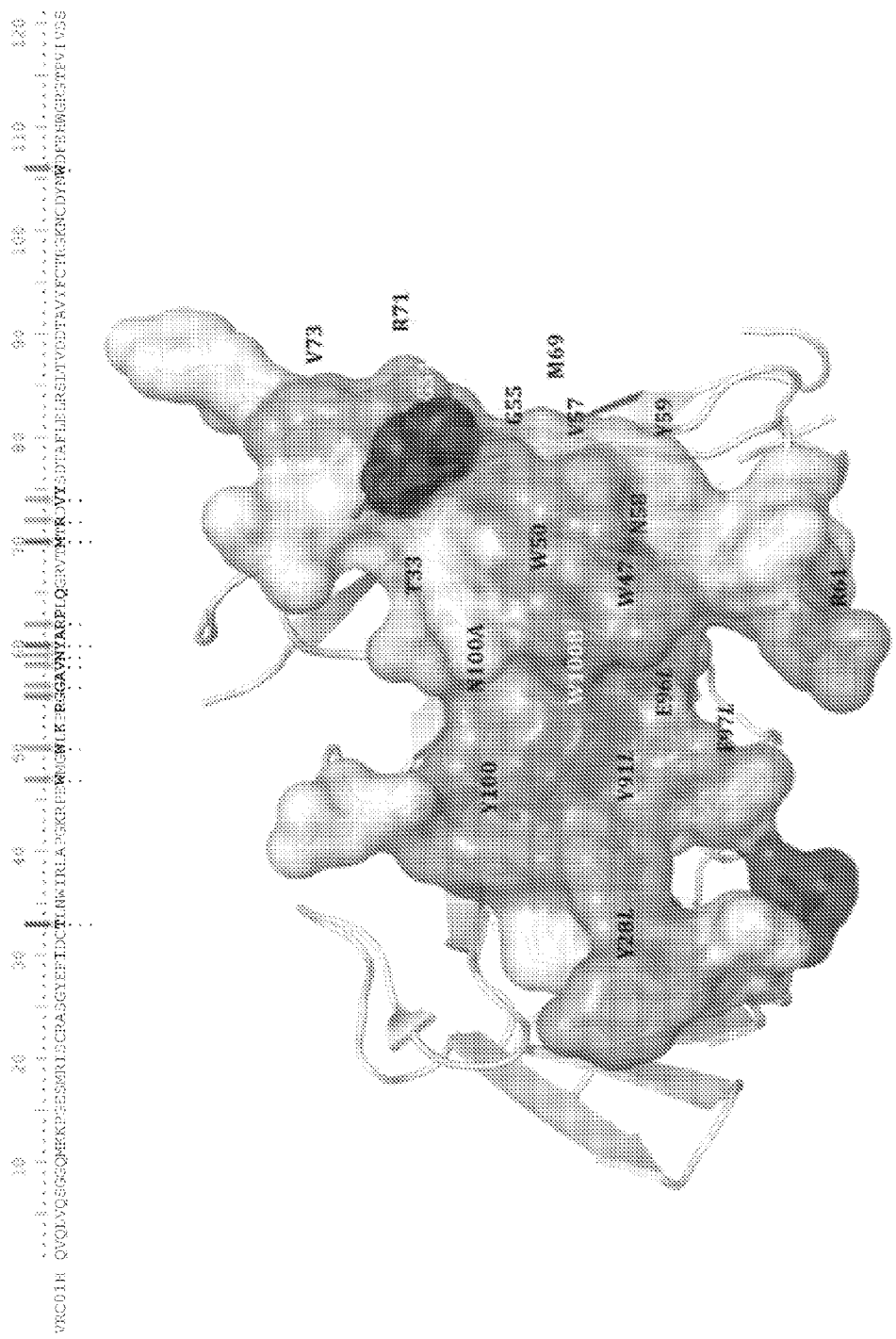

FIG. 19A

| Analyte | RSC3 | |
|---|---|---|
| | Antibody | KD(M) |
| | VRC01-WT | 2.23E-08 |
| | | |
| Heavy chain | I30A | 2.19E-08 |
| | T33A | 7.12E-08 |
| | W47A | 1.62E-07 |
| | W50A | 1.88E-07 |
| | K52A | 6.19E-08 |
| | R53A | 1.43E-08 |
| | G54A | 2.64E-09 |
| | G55A | 1.80E-07 |
| | V57A | 2.10E-07 |
| | N58A | 4.14E-07 |
| | Y59A | 5.47E-08 |
| | R61A | 1.15E-07 |
| | P62A | 2.05E-08 |
| | Q64A | 1.25E-08 |
| | M69A | 5.31E-08 |
| | R71A | 3.37E-07 |
| | V73A | 1.34E-07 |
| | Y74A | 1.58E-08 |
| | D99A | 2.43E-08 |
| | Y100A | 2.34E-07 |
| | N100AA | 1.41E-07 |
| | W100BA | 3.64E-05 |
| | | |
| Light chain | V3A | 6.09E-09 |
| | Q27A | 1.50E-08 |
| | Y28A | 1.13E-07 |
| | S30A | 1.73E-08 |
| | Y91A | 6.33E-07 |
| | E96A | 1.97E-07 |
| | F97A | 9.16E-08 |

FIG. 19B

| Analyte | YU2_FL | |
|---|---|---|
| | Antibody | KD(M) |
| | VRC01-WT | 2.51E-08 |
| Heavy chain | I30A | 1.66E-08 |
| | T33A | 2.58E-08 |
| | W47A | 2.30E-08 |
| | W50A | 3.79E-08 |
| | K52A | 1.46E-08 |
| | R53A | 1.64E-08 |
| | G54A | 6.51E-09 |
| | G55A | 1.73E-08 |
| | V57A | 1.83E-08 |
| | N58A | 3.62E-08 |
| | Y59A | 1.65E-08 |
| | R61A | 2.74E-08 |
| | P62A | 2.51E-08 |
| | Q64A | 1.76E-08 |
| | M69A | 1.93E-08 |
| | R71A | 4.71E-08 |
| | V73A | 2.13E-08 |
| | Y74A | 1.84E-08 |
| | D99A | 2.48E-08 |
| | Y100A | 2.44E-08 |
| | N100AA | 1.49E-08 |
| | W100BA | 1.85E-07 |
| Light chain | V3A | 2.76E-08 |
| | Q27A | 2.54E-08 |
| | Y28A | 3.25E-06 |
| | S30A | 1.33E-06 |
| | Y91A | 7.62E-08 |
| | E96A | 7.47E-08 |
| | F97A | 1.47E-08 |

FIG. 19C

| Analyte | ZM109_FL | |
|---|---|---|
| | Antibody | KD(M) |
| | VRC01-WT | 7.15E-08 |
| Heavy chain | I30A | 5.35E-08 |
| | T33A | 6.23E-08 |
| | W47A | 1.41E-07 |
| | W50A | 8.85E-08 |
| | K52A | 1.12E-07 |
| | R53A | 6.38E-08 |
| | G54A | 7.60E-08 |
| | G55A | 8.34E-08 |
| | V57A | 5.53E-07 |
| | N58A | 1.08E-07 |
| | Y59A | 5.66E-08 |
| | R61A | 7.14E-08 |
| | P62A | 6.05E-08 |
| | Q64A | 5.64E-08 |
| | M69A | 6.24E-08 |
| | R71A | 1.26E-07 |
| | V73A | 8.66E-08 |
| | Y74A | 6.33E-08 |
| | D99A | 6.24E-08 |
| | Y100A | 2.36E-07 |
| | N100AA | 1.45E-07 |
| Light Chain | V3A | 5.47E-08 |
| | Q27A | 7.00E-08 |
| | Y28A | 1.57E-07 |
| | S30A | 5.21E-08 |
| | Y91A | 1.38E-07 |
| | E96A | 1.82E-07 |
| | F97A | 5.62E-08 |

FIG. 23

Anti Cardiolipin Assay

| Anitbodies | | ug/ml | | | | | |
|---|---|---|---|---|---|---|---|
| Heavy | Light | 100.00 | 33.33 | 11.11 | 3.70 | 1.23 | 0.41 |
| 3BNC117 (54T) | | 0.0463 | 0.0391 | 0.0385 | 0.0381 | 0.0386 | 0.0366 |
| VRC03 (54W) | | 0.0384 | 0.0398 | 0.0344 | 0.0302 | 0.0345 | 0.0347 |
| VRC-PG04(54T) | | 0.0387 | 0.0386 | 0.0338 | 0.0344 | 0.0357 | 0.0344 |
| VRC-CH13(54N) | | 0.0416 | 0.0393 | 0.0378 | 0.0394 | 0.0411 | 0.0396 |
| VRC-PG20(54W) | | 0.0484 | 0.0388 | 0.0374 | 0.0382 | 0.0375 | 0.0361 |
| VRC07 | | 0.0562 | 0.0418 | 0.038 | 0.0368 | 0.0371 | 0.0359 |
| VRC07 54A | | 0.0757 | 0.0489 | 0.047 | 0.0439 | 0.0462 | 0.0428 |
| VRC07 54C | | 0.3281 | 0.1272 | 0.0671 | 0.0469 | 0.0416 | 0.0435 |
| VRC07 54D | | 0.0414 | 0.0401 | 0.0413 | 0.042 | 0.041 | 0.0412 |
| VRC07 54E | | 0.0393 | 0.0376 | 0.0405 | 0.038 | 0.0378 | 0.0387 |
| VRC07 54F | | 0.3722 | 0.1356 | 0.0548 | 0.0413 | 0.0406 | 0.04 |
| VRC07 54H | | 0.0888 | 0.0546 | 0.0469 | 0.0455 | 0.0463 | 0.0448 |
| VRC07 54I | | 0.0651 | 0.046 | 0.0426 | 0.0418 | 0.0413 | 0.0412 |
| VRC07 54K | | 0.4107 | 0.1363 | 0.068 | 0.0472 | 0.0451 | 0.0452 |
| VRC07 54L | | 0.0675 | 0.0389 | 0.0388 | 0.0337 | 0.0366 | 0.0359 |
| VRC07 54M | | 0.1397 | 0.0582 | 0.0422 | 0.0362 | 0.0336 | 0.0315 |
| VRC07 54N | | 0.0428 | 0.0357 | 0.0351 | 0.0341 | 0.0335 | 0.034 |
| VRC07 54P | | 0.0647 | 0.0461 | 0.0425 | 0.0441 | 0.0395 | 0.041 |
| VRC07 54Q | | 0.0982 | 0.0478 | 0.0383 | 0.0345 | 0.0358 | 0.0365 |
| VRC07 54R | | 1.6008 | 0.7518 | 0.2767 | 0.1087 | 0.0535 | 0.0403 |
| VRC07 54S | | 0.0503 | 0.0457 | 0.0448 | 0.0421 | 0.0436 | 0.0441 |
| VRC07 54T | | 0.0436 | 0.0422 | 0.0395 | 0.0404 | 0.0395 | 0.04 |
| VRC07 54V | | 0.0495 | 0.042 | 0.0406 | 0.0399 | 0.0502 | 0.0413 |
| VRC07 54W | | 1.2768 | 0.5811 | 0.2538 | 0.0864 | 0.0478 | 0.048 |
| VRC07 54Y | | 0.3701 | 0.1376 | 0.0606 | 0.0433 | 0.0402 | 0.04 |
| VRC01 | | 0.0437 | 0.0438 | 0.0438 | 0.0423 | 0.044 | 0.0467 |

Cells were highlighted yellow as positive based on BH/Duke standard ELISA criteria of 3 times background (0.18)

Additional cells were highlighted peach as potentially positive based on 3 times RSR background (0.12)

FIG. 24
Luc/TZM-bl Assay
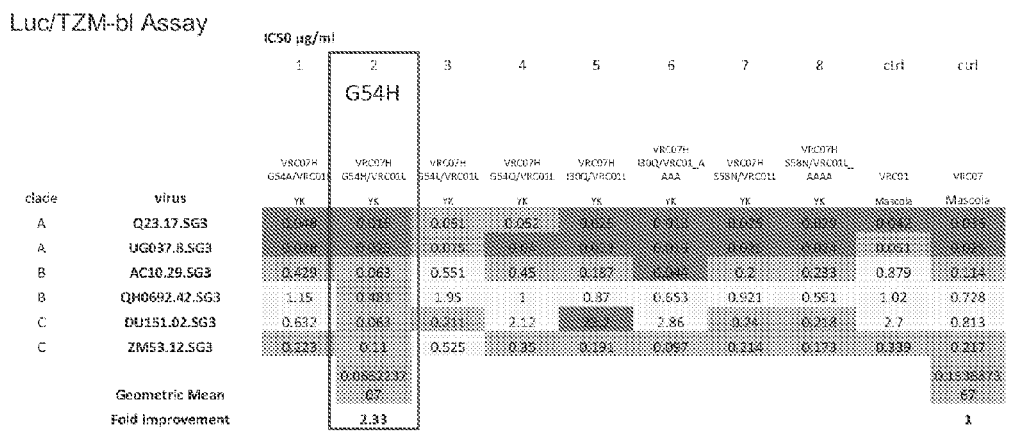
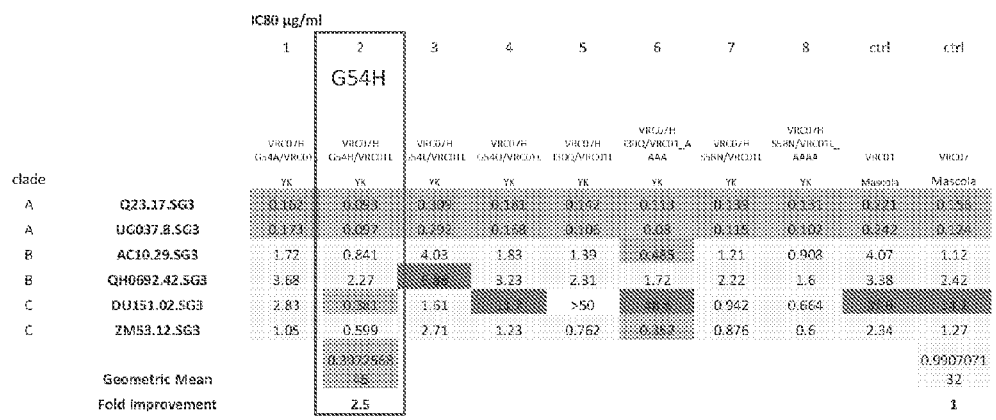

FIG. 25

5'
VRC07_G54H
CAGGTGCGACTGTCGCAGTCTGGAGGTCAGATGAAGAAGCCTGGCGACTCGA
TGAGAATTTCTTGTCGGGCTTCGGGATACGAATTTATTAATTGTCCAATAAAT
TGGATTCGGCTGGCCCCCGGAAAAAGGCCTGAGTGGATGGGATGGATGAAGC
CTAGGCATGGGGCCGTCAGTTACGCACGTCAACTTCAGGGCAGAGTGACCAT
GACTCGAGACATGTATTCCGAGACAGCCTTTTGGAGCTCCGTTCCTTGACAT
CCGACGACACGGCCGTCTATTTTGTACTCGGGGAAAATATTGCACTGCGCGC
GACTATTATAATTGGGACTTCGAACACTGGGGCCAGGGCACCCCGGTCACCG
TCTCGTCA

QVRLSQSGGQMKKPGDSMRISCRASGYEFINCPINWIRLAPGKRPEWMG
WMKPRHGAVSYARQLQGRVTMTRDMYSETAFLELRSLTSDDTAVYFCTRG
KYCTARDYYNWDFEHWGQGTPVTVSS

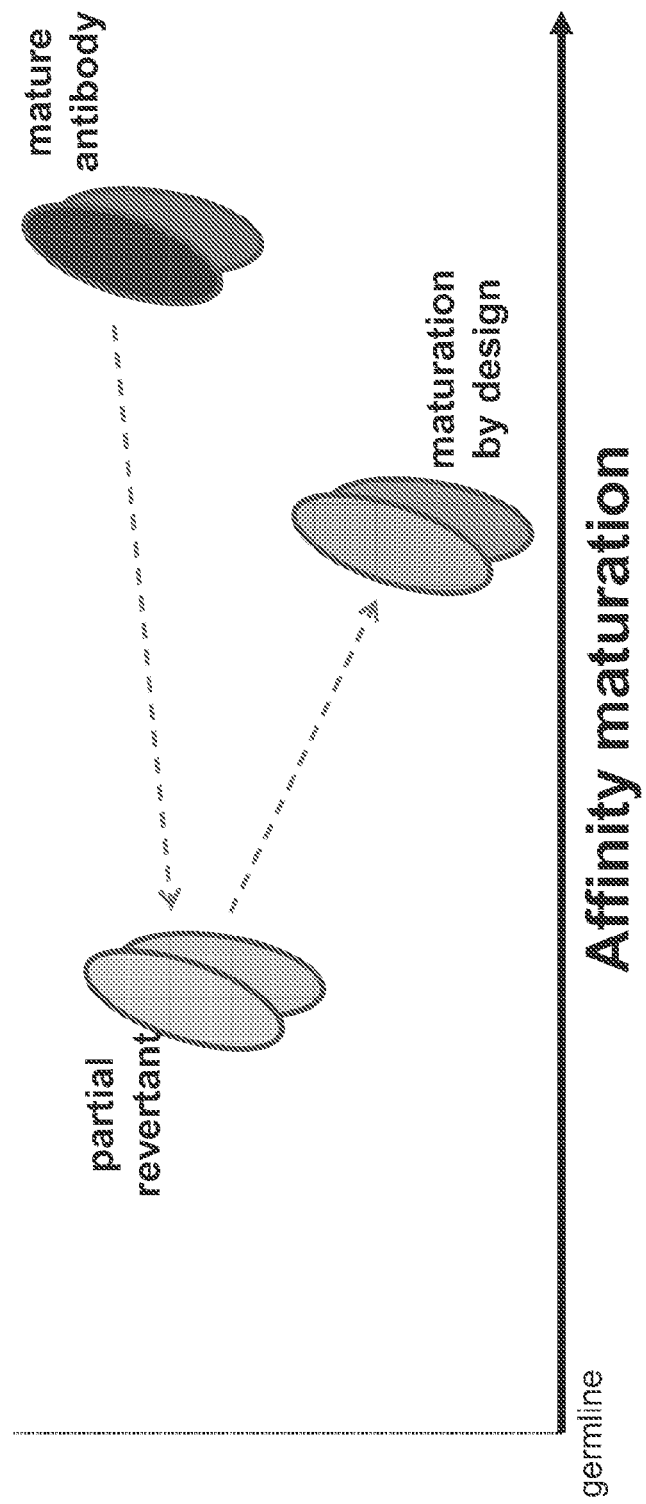

| virus | VRC07gh vH05.3 / VRC01L | VRC07gh vH05.3 / VRC01-El-del | VRC07gh vH05.3.1 / VRC01L | VRC07gh vH05.3.1 / VRC01-El-del | VRC07 |
|---|---|---|---|---|---|
| | RR | RR | RR | RR | mascola |
| Q23.17.SG3 | | | | | |
| UG037.8.SG3 | | | | | 0.104 |
| AC10.29.SG3 | 0.147 | 0.154 | 0.316 | 0.303 | 0.479 |
| QH0692.42.SG3 | 0.384 | 0.263 | 0.544 | 0.405 | 0.477 |
| DU151.02.SG3 | | 1.41 | | 1.15 | 3.61 |
| ZM53.12.SG3 | 0.244 | 0.234 | 0.328 | 0.312 | 0.285 |
| | | | | | |
| Geometric mean IC50 | 0.234 | 0.137 | 0.248 | 0.164 | 0.299 |
| | | | | | |
| Fold improvement | 1.27 | 2.17 | 1.20 | 1.82 | 1.00 |

FIG. 32

| VRC07H | VRC01L | VRC07H | VRC01L |
|---|---|---|---|
| I30Q_S58N | VRC01L_1aa_del | I30Q_S58N | VRC01L_2aa_del |
| I30Q_S58N | VRC01L-2aa_del_V3A | I30Q_S58N | lh_01 |
| I30Q_S58N | VRC01L-2aa_del_V3G | I30Q_S58N | lh_02 |
| I30Q_S58N | VRC01L_3aa_del | I30Q_S58N | lh_03 |
| I30Q_S58N | VRC01L_4aa_del | I30Q_S58N | lh_04 |
| I30Q_S58N | VRC01L-G | I30Q_S58N | lh_01_2aa_del |
| I30Q_S58N | VRC01L-GG | I30Q_S58N | lh_02_2aa_del |
| I30Q_S58N | VRC01L-GGG | I30Q_S58N | lh_01_67S,72T |
| I30Q_S58N | VRC01L-GGGG | I30Q_S58N | lh_02_67S,72T |
| I30Q_S58N | VRC01L-A | I30Q_S58N | lh_01_67S,72T_2aa_del |
| I30Q_S58N | VRC01L-AA | I30Q_S58N | lh_02_67S,72T_2aa_del |
| I30Q_S58N | VRC01L-AAA | I30Q_S58N | hp_L02_72F_2aa_del |
| I30Q_S58N | VRC01L-AAAA | I30Q_S58N | hp_L02_72N_2aa_del |
| I30Q_S58N | hp-l02_2aa_del | I30Q_S58N | ghvL05_2aa_del |
| I30Q_S58N | hp-l02_2aa_del_V3A | | |

FIG. 34

BROADLY NEUTRALIZING HIV-1 VRC07 ANTIBODIES THAT BIND TO THE CD4-BINDING SITE OF THE ENVELOPE PROTEIN

CROSS REFERENCE TO RELATED APPLICATIONS

This is the U.S. National Stage of International Application No. PCT/US2012/068827, filed Dec. 10, 2012, which was published in English under PCT Article 21(2), which in turn claims the benefit of U.S. Provisional Application No. 61/698,452, filed on Sep. 7, 2012, U.S. Provisional Application No. 61/613,431, filed Mar. 20, 2012, and U.S. Provisional Application No. 61/568,520, filed Dec. 8, 2011; all of these prior provisional applications are incorporated by reference in their entirety.

FIELD OF THE DISCLOSURE

Monoclonal neutralizing antibodies are disclosed that bind to HIV-1 gp120, as well as their identification and use.

BACKGROUND

Human Immunodeficiency Virus (HIV) infection, and the resulting Acquired Immunodeficiency Syndrome (AIDS) remain threats to global public health, despite extensive efforts to develop anti-HIV therapeutic agents. Some HIV-infected individuals eventually develop broadly neutralizing antibodies (bNAbs), which neutralize a large panel of HIV viruses. These individuals show delayed development of AIDS, even in the absence of any treatment for HIV infection.

One previously characterized HIV-1 neutralizing mAb, called b12, can bind to a site on gp120 that is required for viral attachment to its primary cellular receptor, CD4. mAb b12 was derived from a phage display library, a process which makes it impossible to know if the antibody was naturally present in an infected person, or was the result of a laboratory combination of antibody heavy and light chains. b12 can neutralize about 75% of Glade B strains of HIV-1 (those most common in North America), but it neutralizes less than 50% of other strains of HIV-1 found worldwide. Therefore, there is a need to develop additional neutralizing antibodies for HIV-1.

SUMMARY OF THE DISCLOSURE

Disclosed herein is the identification of the VRC07 monoclonal antibody, which specifically binds to the CD4 binding site of the gp120 protein of HIV, and is neutralizing VRC07 is a VRC01-like monoclonal antibody, and includes a novel heavy chain ("VRC07 heavy chain"). This heavy chain can cross-complement with the light chain of the VRC01 monoclonal antibody. VRC07 heavy chain is a clonal variant of the VRC01 heavy chain. An antibody including the VRC07 heavy chain cross complemented with the VRC01 light chain has increased binding affinity for gp120 and does not have significantly increased self-reactivity compared to VRC01. Further disclosed herein are variants of the VRC07 heavy chain and the VRC01 light chain, and cross-complemented monoclonal antibodies including such variants that have increased binding affinity for gp120 and are not self-reactive, or have only low self reactivity, for example, compared to VRC01. In several embodiments, the disclosed variants of the VRC07 heavy chain and the VRC01 light chain include framework region amino acid substitutions (compared to VRC07 heavy chain or VRC01 light chain), but only include up to two amino acid substitutions in the CDRs (compared to VRC07 heavy chain or VRC01 light chain). Thus, disclosed herein is a class of monoclonal antibodies that have increased binding affinity for gp120, and are not self-reactive or have low self reactivity. In some embodiments, the disclosed antibodies further are not immunogenic, or have low immunogenicity.

Accordingly, isolated monoclonal neutralizing antibodies that specifically bind HIV-1 gp120 are provided herein. In certain examples, the binding and/or neutralization ability of these antibodies has been optimized. Also disclosed are compositions including these antibodies that specifically bind gp120, nucleic acids encoding these antibodies, expression vectors comprising the nucleic acids, and isolated host cells that express the nucleic acids. The antibodies can be fully human. In several embodiments, the antibodies include a heavy chain variable domain and a light chain variable domain.

In some embodiments, the isolated monoclonal antibody includes a heavy chain variable domain comprising amino acids 26-33 (CDR1), 51-58 (CDR2) and 97-114 (CDR3) of SEQ ID NO: 40, wherein the antibody specifically binds gp120 of HIV-1, wherein the antibody is neutralizing. In specific non-limiting examples, the isolated monoclonal antibody includes a heavy chain variable domain comprising (a) amino acids 26-33 (CDR1), 51-58 (CDR2) and 97-114 (CDR3) of SEQ ID NO: 40, wherein $X_2$ is G; or (b) amino acids 26-33 (CDR1), 51-58 (CDR2) and 97-114 (CDR3) of SEQ ID NO: 40, wherein $X_2$ is H, wherein the antibody specifically binds gp120 of HIV-1, and wherein the antibody is neutralizing.

In some embodiments, the heavy chain variable domain of the antibody comprises SEQ ID NO: 40. In some embodiments, the heavy chain variable domain of the antibody comprises one of SEQ ID NO: 32, SEQ ID NO: 258, SEQ ID NO: 259, or SEQ ID NO: 260.

In additional embodiments, the light chain variable domain of the antibody comprises amino acids 27-30 (CDR1), 48-50 (CDR2) and 87-91 (CDR3) of SEQ ID NO: 238. In specific non-limiting examples, the isolated monoclonal antibody includes a light chain variable domain comprising (a) amino 27-30 (CDR1), 48-50 (CDR2) and 87-91 (CDR3) of SEQ ID NO: 238, wherein $X_{11}$ is D (VRC01 light chain CDRs with F97D), (b) amino acids 27-30 (CDR1), 48-50 (CDR2) and 87-91 (CDR3) of SEQ ID NO: 238, wherein $X_{11}$ is K (VRC01 light chain CDRs with F97K), (c) amino acids 27-30 (CDR1), 48-50 (CDR2) and 87-91 (CDR3) of SEQ ID NO: 238, wherein $X_{11}$ is S (VRC01 light chain CDRs with F97S); or (d) amino acids 27-30 (CDR1), 48-50 (CDR2) and 87-91 (CDR3) of SEQ ID NO: 238, wherein $X_{11}$ is H (VRC01 light chain CDRs with F97H).

In some embodiments, the light chain variable domain of the antibody comprises SEQ ID NO: 238. In some embodiments, the light chain variable domain of the antibody comprises one of SEQ ID NO: 9, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, or SEQ ID NO: 237.

In several embodiments, a disclosed monoclonal antibody that specifically binds to gp120 includes a light chain including a disclosed light chain variable domain cross-complemented with a heavy chain including a disclosed heavy chain variable domain.

The antibodies and compositions disclosed herein can be used for a variety of purposes, such as for detecting an HIV-1 infection or diagnosing AIDS in a subject. These methods can include contacting a sample from the subject diagnosed with HIV-1 or AIDS with a human monoclonal antibody that specifically binds gp120, and detecting binding of the antibody to the sample. An increase in binding of the antibody to the sample relative to binding of the antibody to a control sample confirms that the subject has an HIV-1 infection and/or AIDS. In some embodiments, the methods further comprise contacting a second antibody that specifically binds gp120 with the sample, and detecting binding of the second antibody. In some non-limiting examples an increase in binding of the antibody to the sample relative to a control sample detects HIV-1 in the subject. In some non-limiting examples, the antibody specifically binds soluble gp120 in the sample. In some embodiments, the methods further comprise contacting a second antibody that specifically recognizes the gp120 specific antibody with the sample and detecting binding of the second antibody.

In additional embodiments, a method is disclosed for treating a subject with or at risk of an HIV infection, such as, but not limited to, an HIV seropositive subject or a subject with AIDS, or a person who has been exposed to potential HIV infection but not yet seroconverted. The methods include administering a therapeutically effective amount of one or more of the monoclonal antibodies, antigen binding fragment thereof, or nucleic acid encoding antibody or antigen binding fragment, disclosed herein.

The foregoing and other features and advantages of this disclosure will become more apparent from the following detailed description of a several embodiments which proceeds with reference to the accompanying figures.

BRIEF DESCRIPTION OF THE FIGURES

FIGS. 1A and 1B are a set of dot plots illustrating results of isolation of individual memory B cells producing anti-gp120 antibodies by cell sorting. About twenty million peripheral blood mononuclear cells (PBMC) from donor 45 that were incubated with biotin-labeled RSC3 and ΔRSC3 complexed with SA-APC and SA-PE respectively, prior to addition to cells. As illustrated in the figure, fifty memory B cells with the phenotype of CD3−, CD8−, aqua blue−, CD14−, CD19+, CD20+, IgG+, IgM−, RSC3+ and ΔRSC3− were sorted using illustrated strategy into individual wells of a 96-well PCR plate containing lysis buffer. The VRC07b and VRC07c antibodies were identified from these sorted cells.

FIG. 2 is a protein sequence alignment showing the alignment of the heavy chain sequences of the VRC01 (SEQ ID NO: 5), VRC02 (SEQ ID NO: 197), VRC07 (SEQ ID NO: 2), VRC07b (SEQ ID NO: 3), VRC07c (SEQ ID NO: 4) and NIH4546 (SEQ ID NO: 196) monoclonal antibodies and the IGHV1-2*02 germline sequence (SEQ ID NO: 195). The framework (FR) and complementarity determining region (CDR) positions are shown.

Figure 3A:
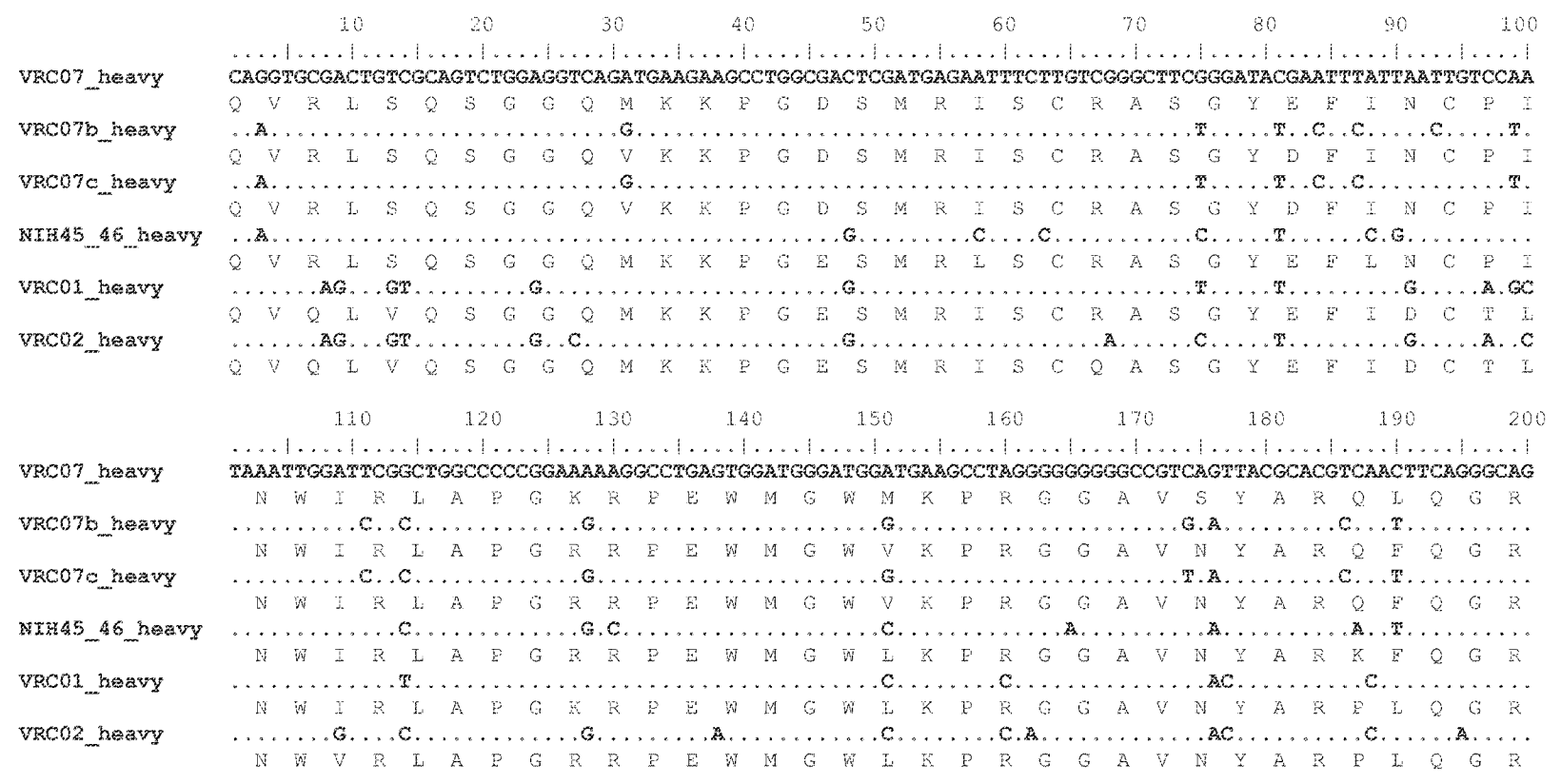
Figure 3B:
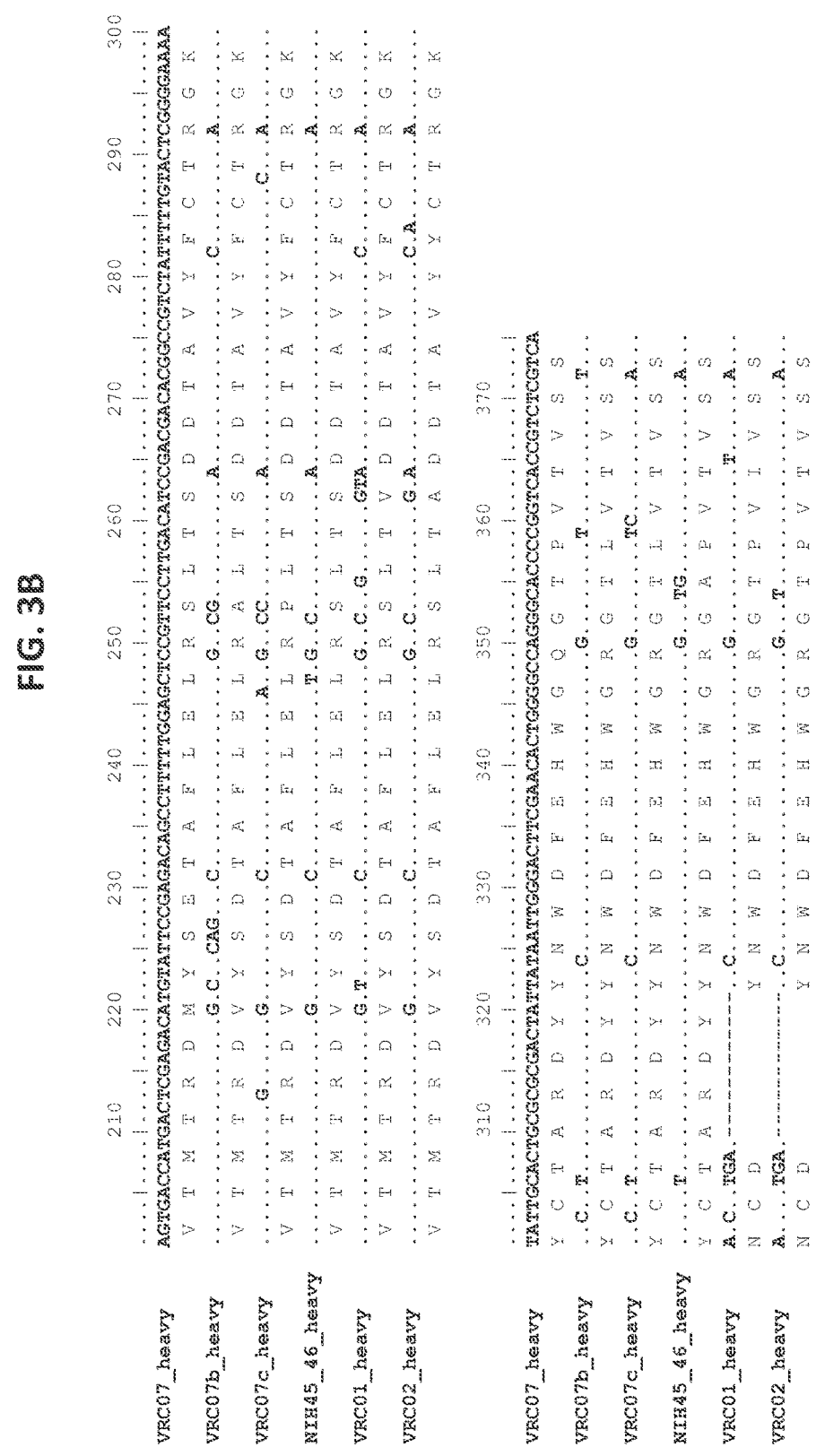

FIGS. 3A-3B are a protein and nucleotide sequence alignment showing the alignment of the heavy chain protein sequences of the VRC01 (SEQ ID NO: 5), VRC02 (SEQ ID NO: 197), VRC07 (SEQ ID NO: 2), VRC07b (SEQ ID NO: 3), VRC07c (SEQ ID NO: 4) and NIH4546 (SEQ ID NO: 196) heavy chain variable domains and the corresponding nucleotide sequence encoding the VRC07 heavy chain variable domain (SEQ ID NO: 10) as well as the nucleotide residues that differ from the VRC07 nucleotide sequence.

Figure 4:
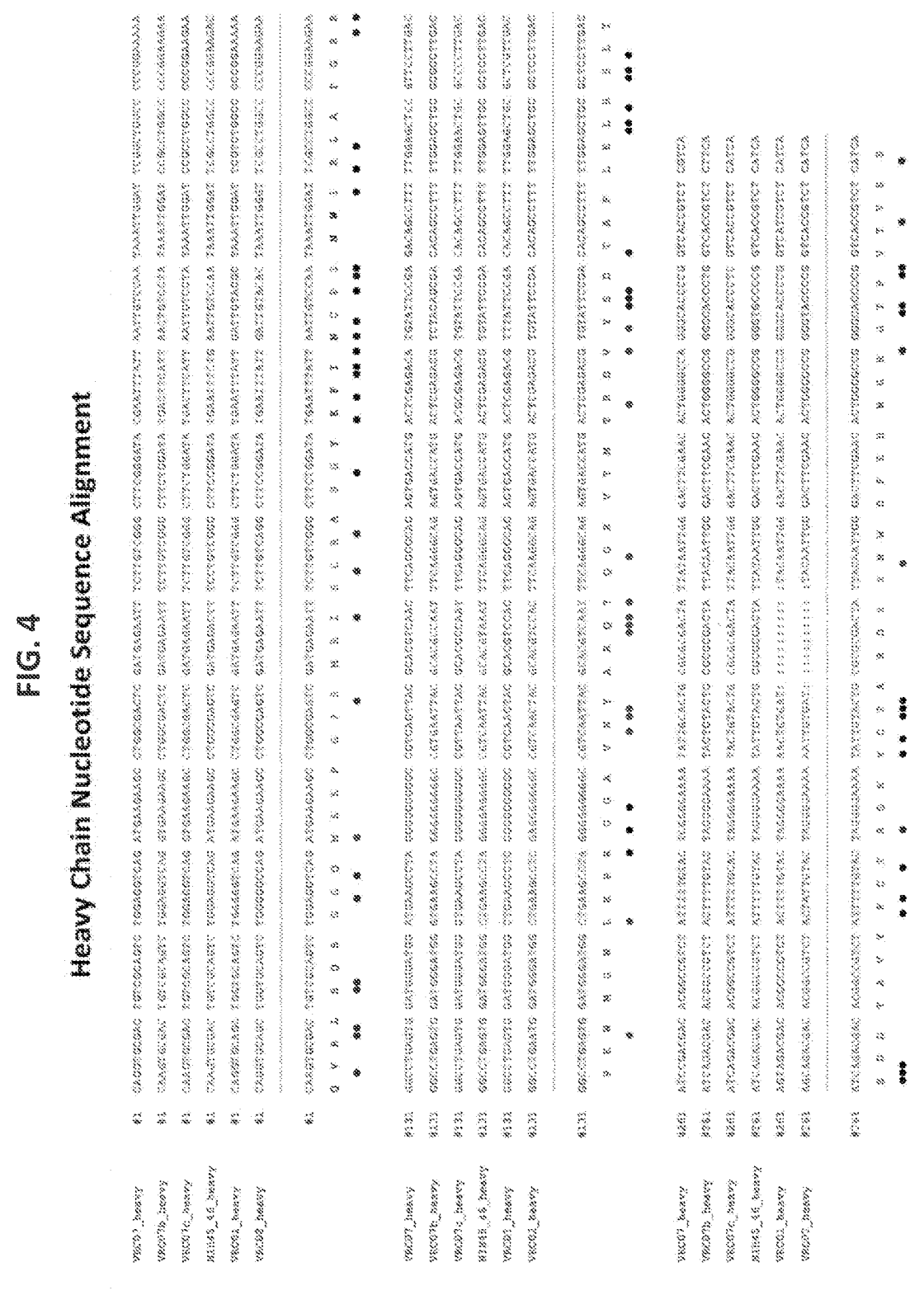

FIG. 4 shows the alignment of the nucleotide sequences encoding the heavy chains of the VRC01 (SEQ ID NO: 13), VRC02 (SEQ ID NO: 197), VRC07 (SEQ ID NO: 10), VRC07b (SEQ ID NO: 11), VRC07c (SEQ ID NO: 12) and NIH4546 (SEQ ID NO: 196) monoclonal antibodies.

FIG. 5 is a protein sequence alignment showing the alignment of the light chain variable domain sequences of the VRC01 (SEQ ID NO: 9), VRC07b (SEQ ID NO: 7) and VRC07c (SEQ ID NO: 8) monoclonal antibodies. The IMGT CDR1, CDR2 and CDR3 sequences of each light chain sequence are underlined.

FIG. 6 is a table showing the results of antibody neutralization assays performed using the VRC01, VRC03, VRC-PG04 and VRC07 monoclonal antibodies. The VRC07 antibody included the VRC07 heavy chain variable domain and the VRC01 light chain variable domain. Neutralization was measured using HIV-1 Env-pseudoviruses (expressing HIV Env from the indicated HIV isotypes) to infect TZM-bl cells as described previously (see, e.g., PCT Pub. WO2011/038290) and luciferase assay was used as the output indicator. The virus input was set at a multiplicity of infection of approximately 0.01, which generally results in 100,000 to 400,000 relative light units (RLU) in a luciferase assay (Bright Glo, Promega, Madison, Wis.). The antibody concentrations were defined at the point of incubation with virus supernatant. Neutralization curves were fit by nonlinear regression using a 5-parameter hill slope equation. The 50% and 80% inhibitory concentrations (IC50 and IC80) are listed in the table and were reported as the antibody concentrations required to inhibit infection by 50% and 80% respectively.

FIGS. 7A-D are a set of tables showing the results of antibody neutralization assays performed using the VRC01, VRC03, VRC-PG04, VRC-CH31, 4E10 and VRC07 monoclonal antibodies. The VRC07 antibody included the VRC07 heavy chain variable domain (SEQ ID NO: 2) and the VRC01 light chain variable domain (SEQ ID NO: 9). Neutralization was measured as described in Example 2.

FIGS. 8A-8F show sequence alignments and tables concerning the VRC07 heavy chain variable domain and the VRC01 light chain variable domain. FIGS. 8A and 8B show protein sequence alignments of the heavy chain variable domain sequences of the VRC01 (SEQ ID NO: 5), VRC02 (SEQ ID NO: 197), VRC07 (SEQ ID NO: 2), VRC07b (SEQ ID NO: 3), VRC07c (SEQ ID NO: 4) and NIH4546 (SEQ ID NO: 196) monoclonal antibodies. The FR and CDR positions are shown using the IMGT (FIG. 8B) and Kabat (FIG. 8A) numbering schemes. FIG. 8C shows the protein sequence of the VRC01 light chain (SEQ ID NO: 9), with the Kabat and IMGT CDRs indicated. FIGS. 8D-8F show a table indicating the linear and Kabat positioning of the amino acids of the VRC07 heavy chain variable domain and the VRC01 light chain variable domain.

FIG. 9 illustrates one strategy used to optimize the VRC07 monoclonal antibody.

G54W, S58N (SEQ ID NO: 26) monoclonal antibodies. The FR and CDR positions as determined using the IMGT and Kabat numbering schemes are shown.

Figure 12A:
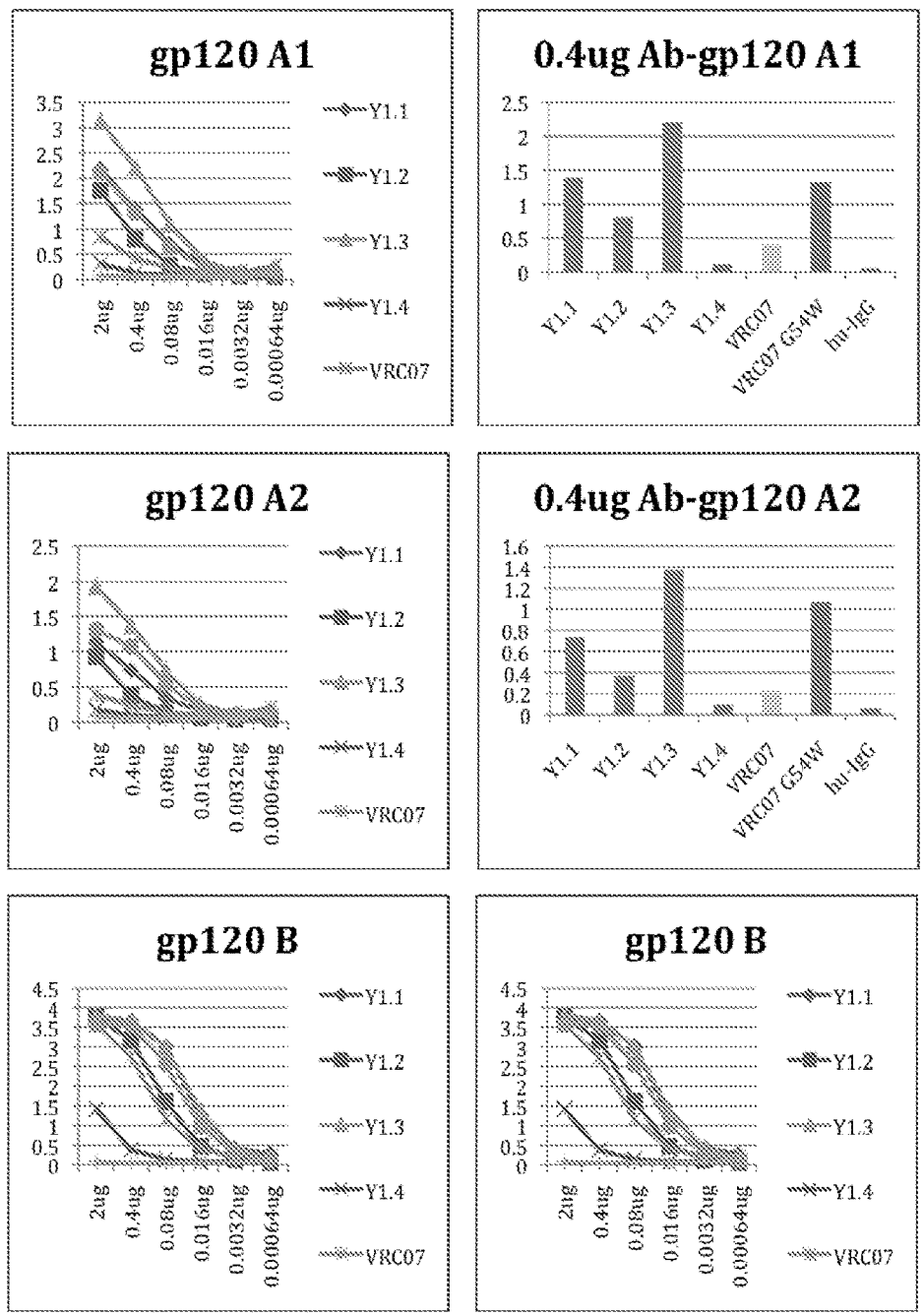
Figure 12B:
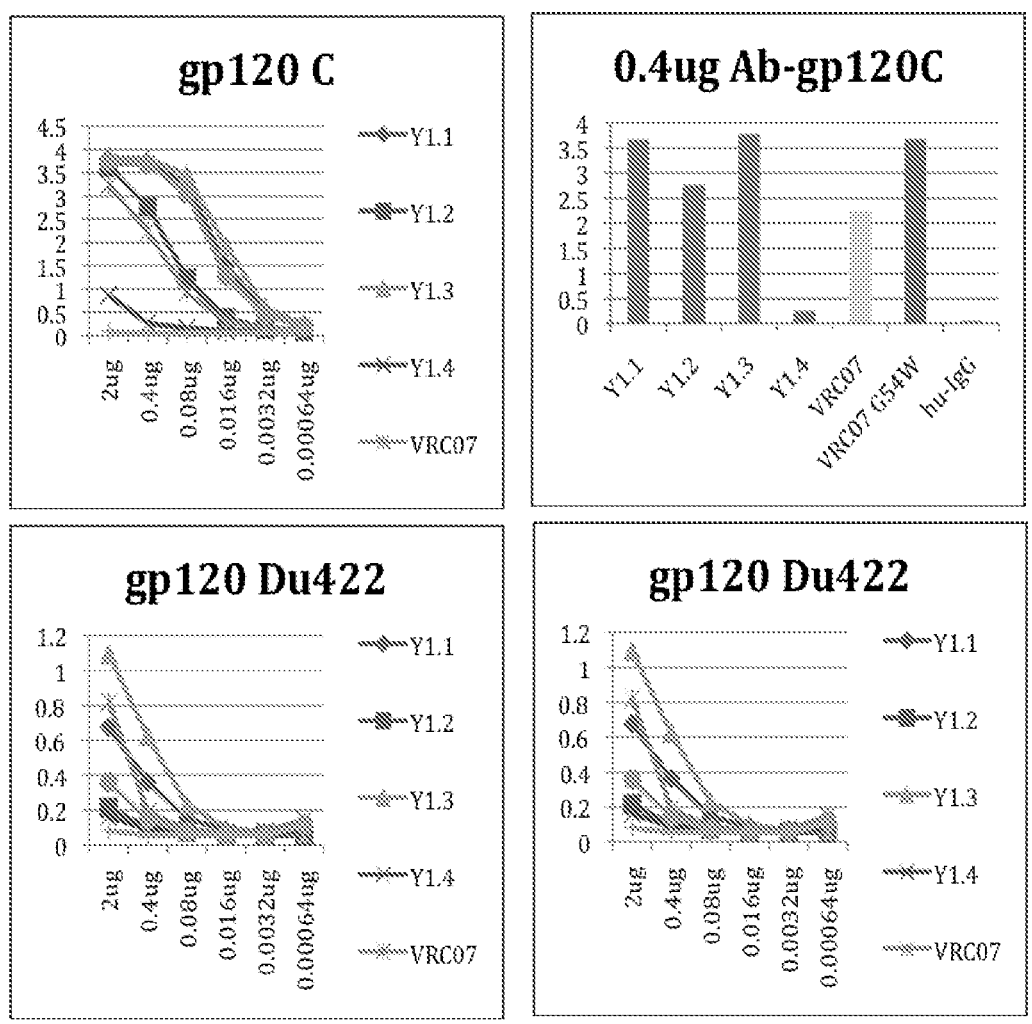
Figure 13A:
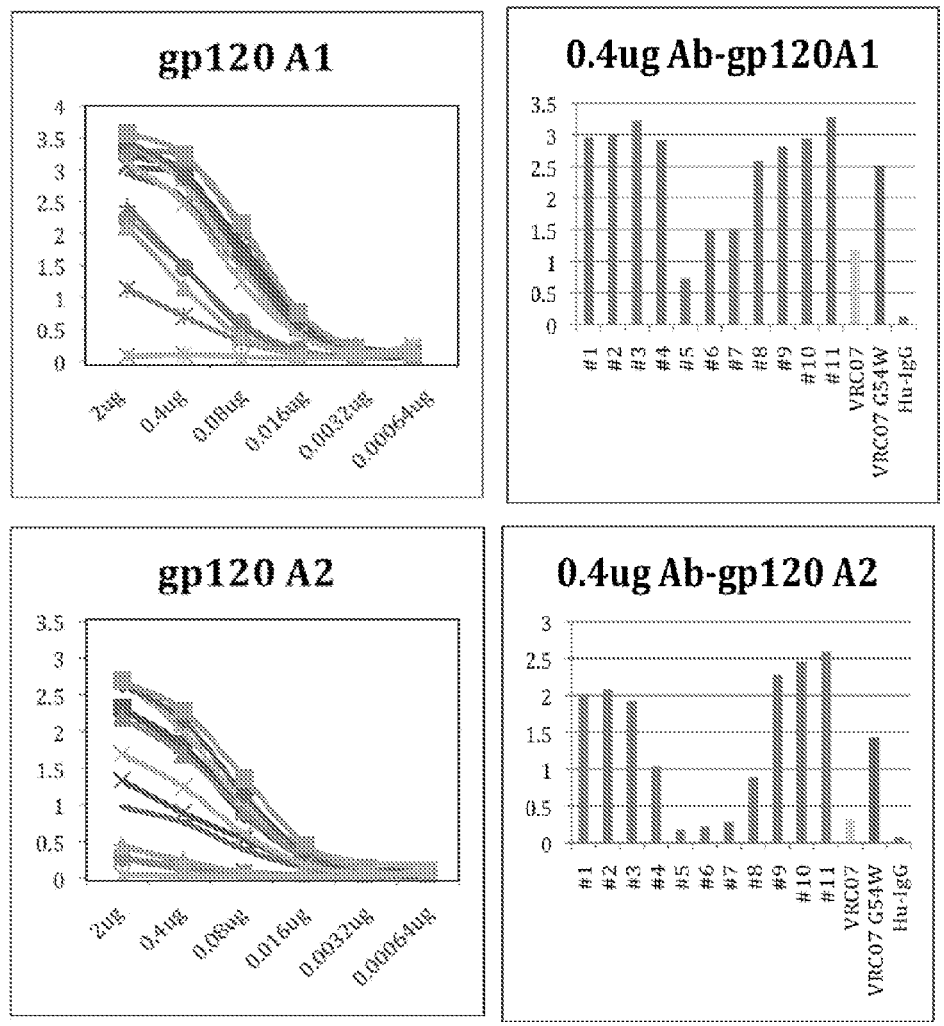
Figure 13B:
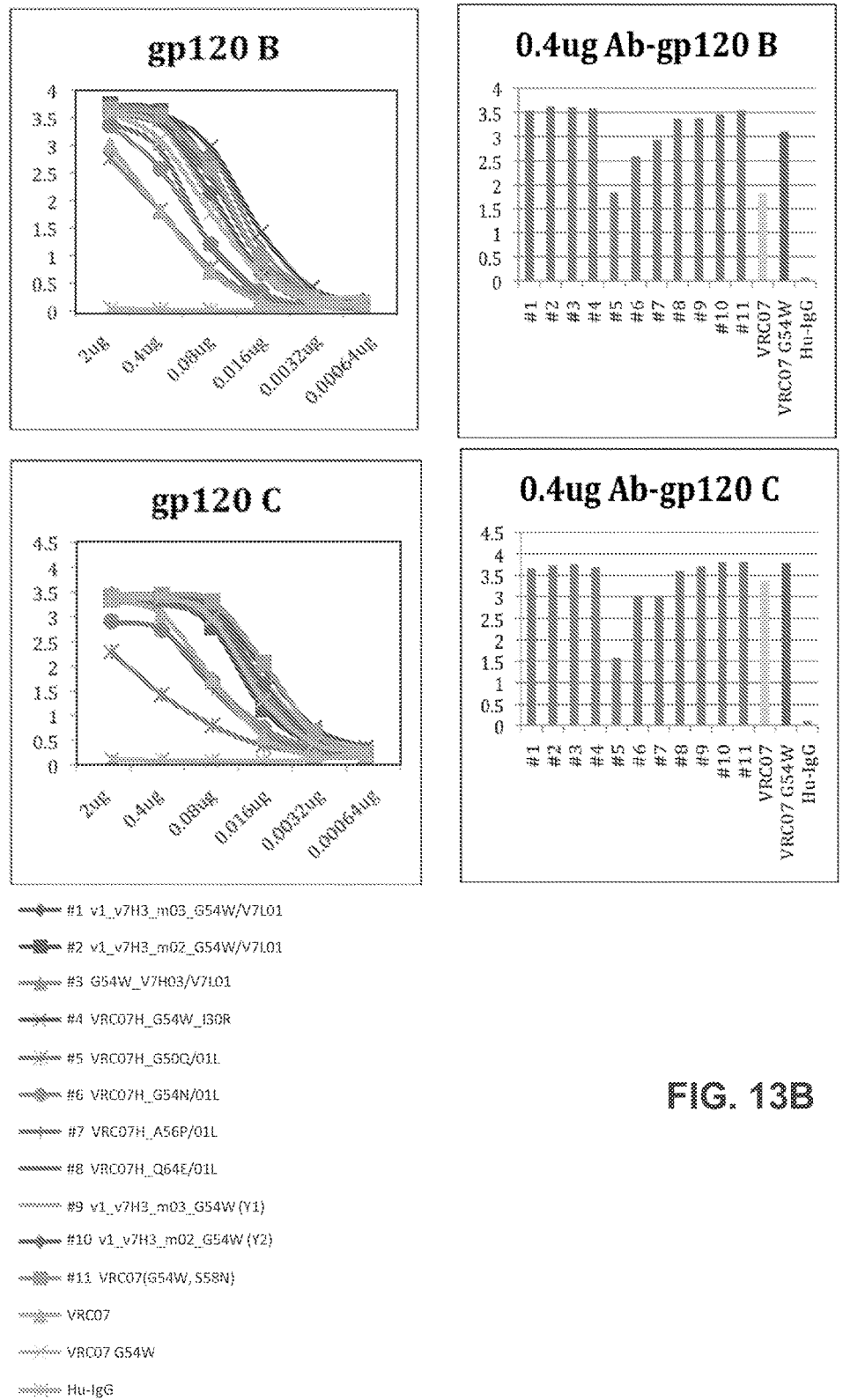
Figure 13D:
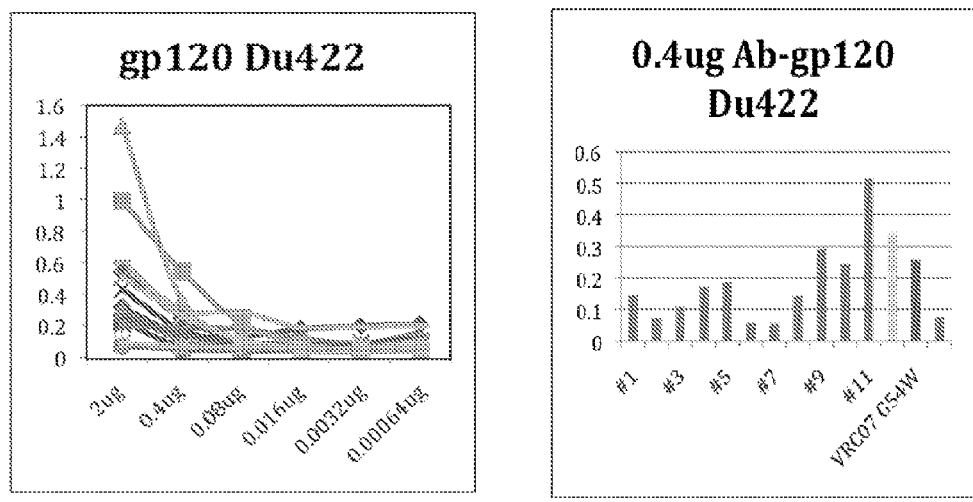

FIGS. 12A-12B are a series of graphs illustrating the results of ELISA measurements of binding of the indicated monoclonal antibodies to the indicated gp120 proteins. Tested monoclonal antibodies include antibodies with VRC07, VRC07(G54W), VRC07(G54W, I30Q), VRC07 (G54W, I30R) and VRC07(G54W, S58N) heavy chains, each complemented with the VRC01 light chain.

FIGS. 13A-13D are a series of graphs illustrating the results of ELISA measurements of binding of the indicated monoclonal antibodies to the indicated gp120 proteins.

FIG. 14 is a set of tables showing the results of HIV-1 neutralization assays performed using monoclonal antibodies including the VRC07, v1_v7h3_m03_G54W, v1_v7h3_m02_G54W, VRC07(G54W), VRC07(G54W, I30Q), VRC07(G54W, I30R) or VRC07(G54W, S58N) heavy chains, each complemented with the VRC01 light chain. Neutralization was measured using the methods described Example 2.

Figure 15K:
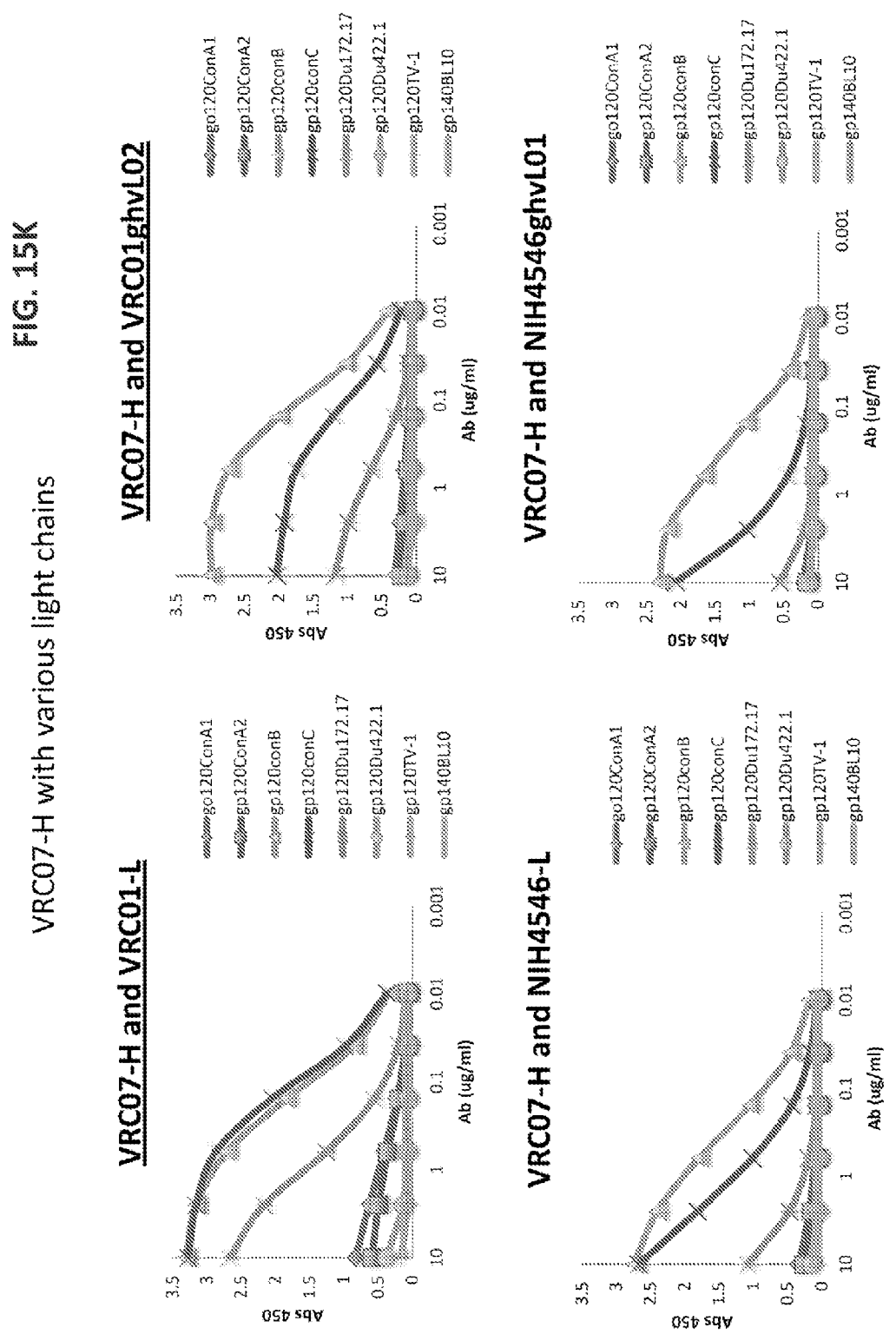
Figure 15M:
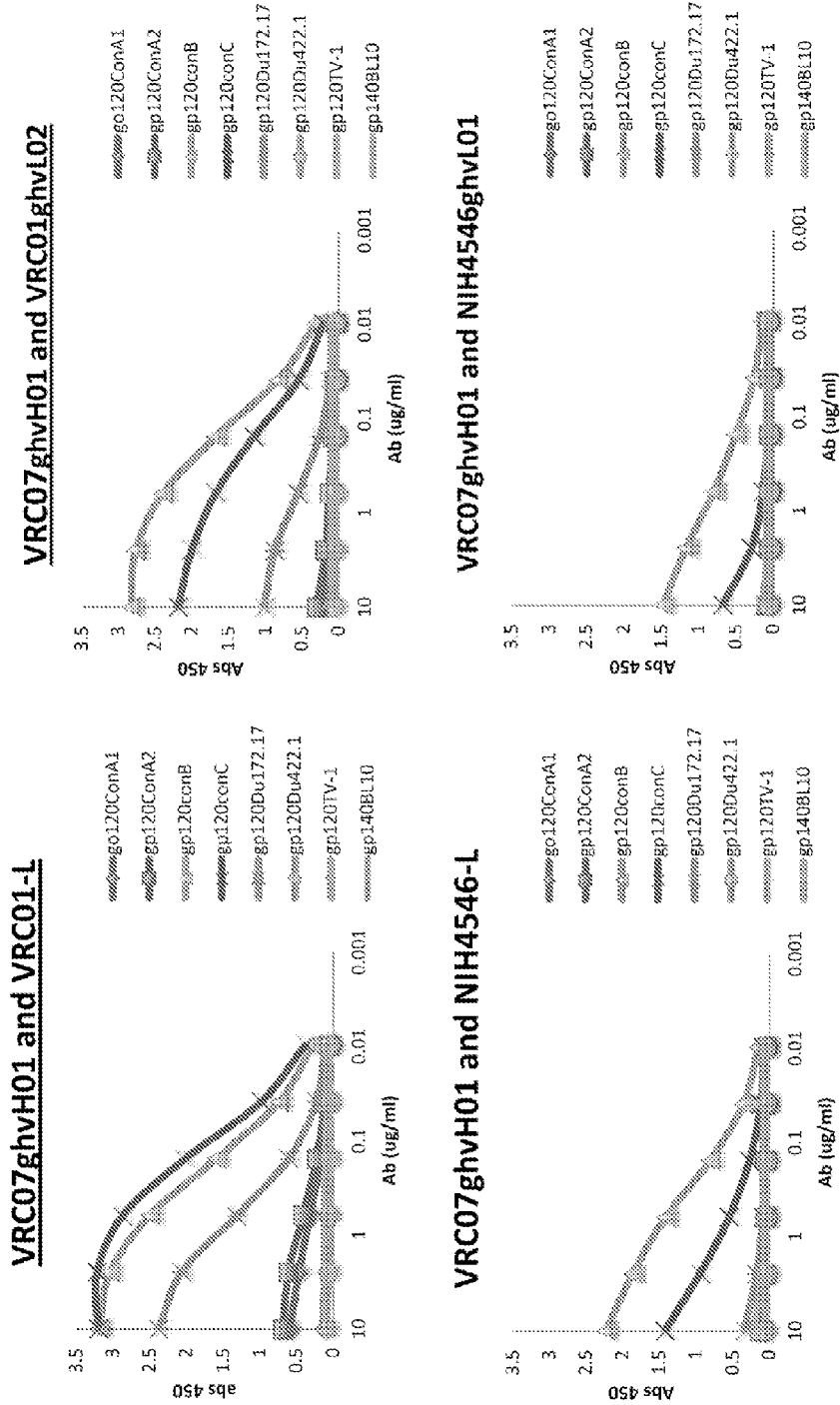
Figure 15S:
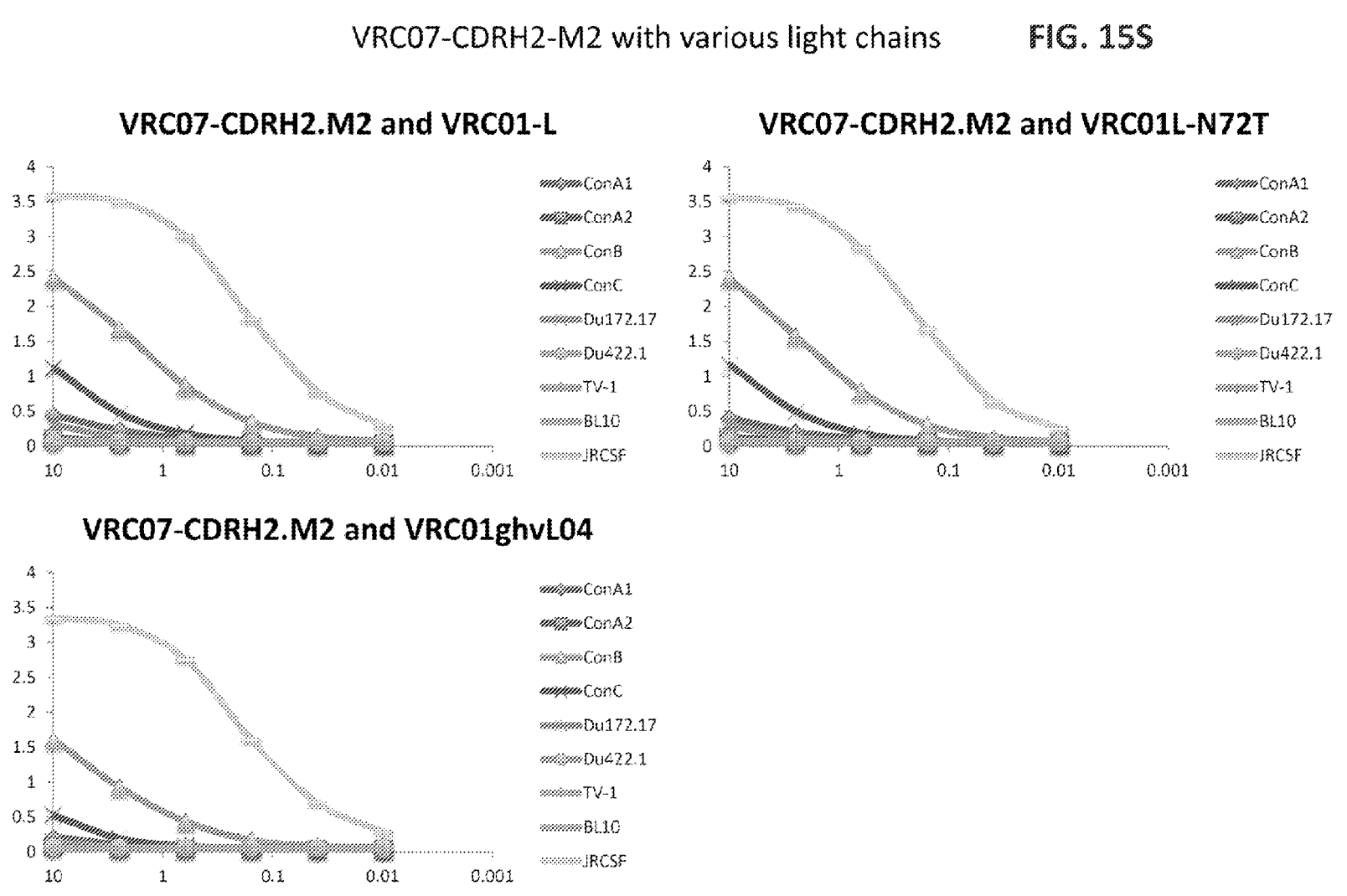
Figure 15U:
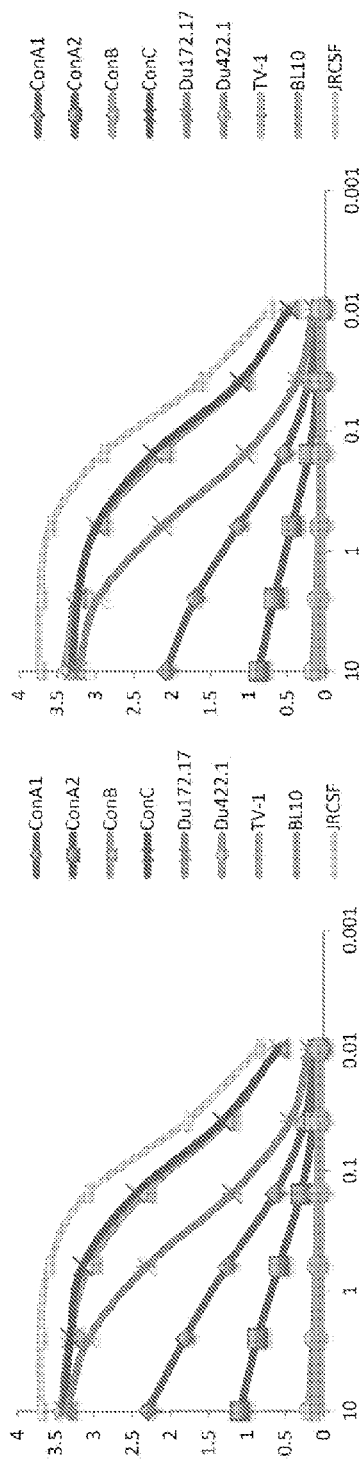
Figure 15W:
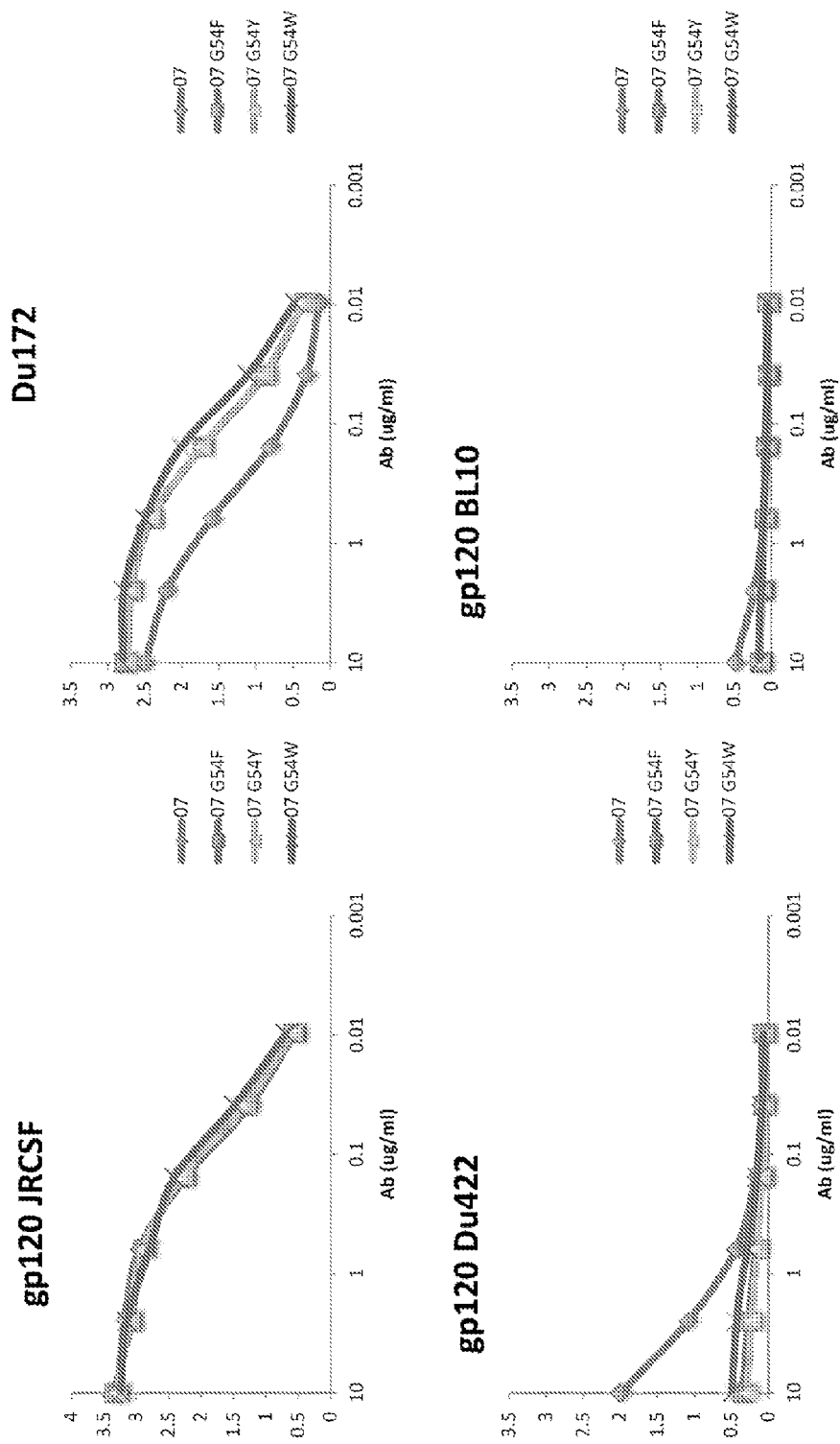
Figure 15X:
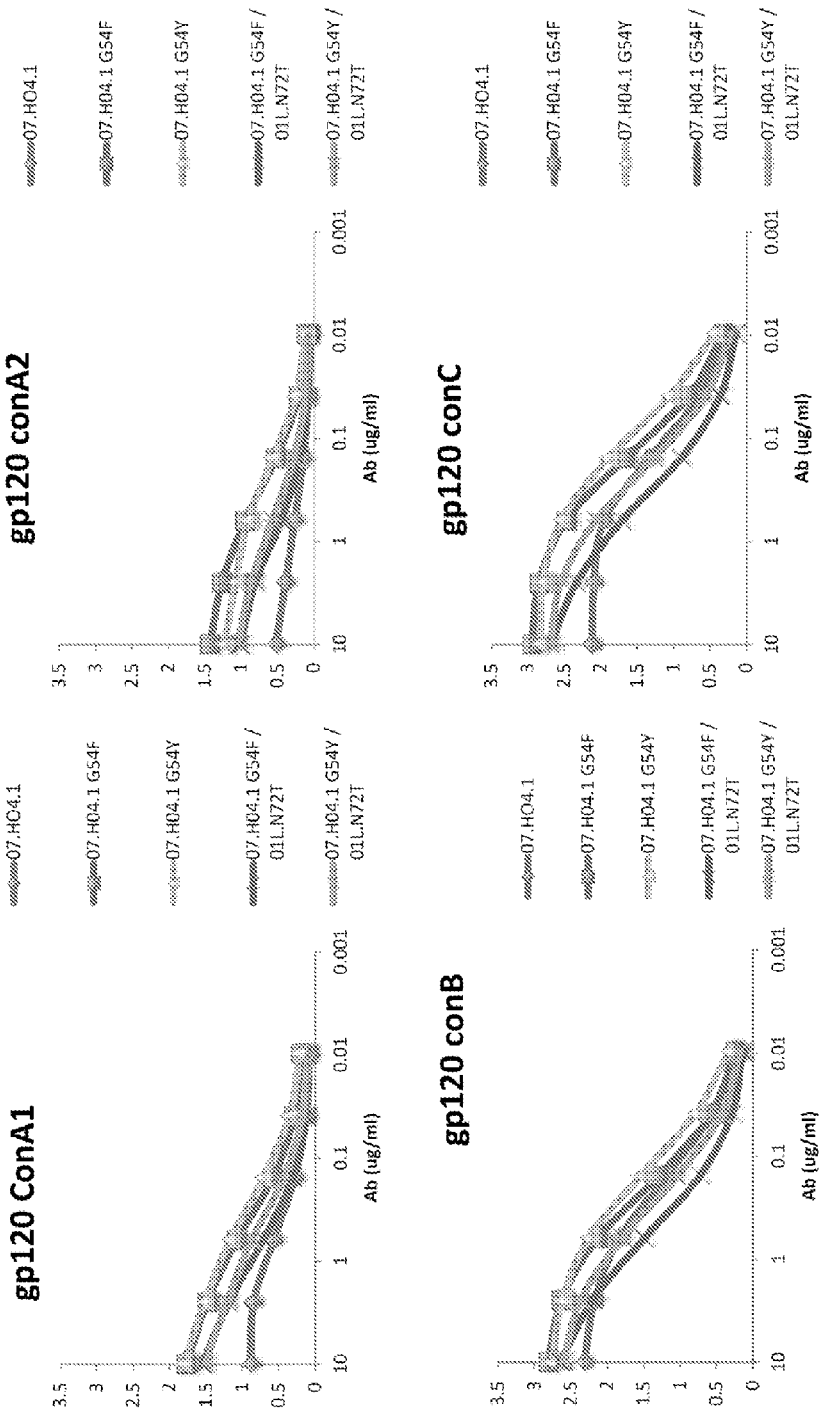
Figure 15Z:
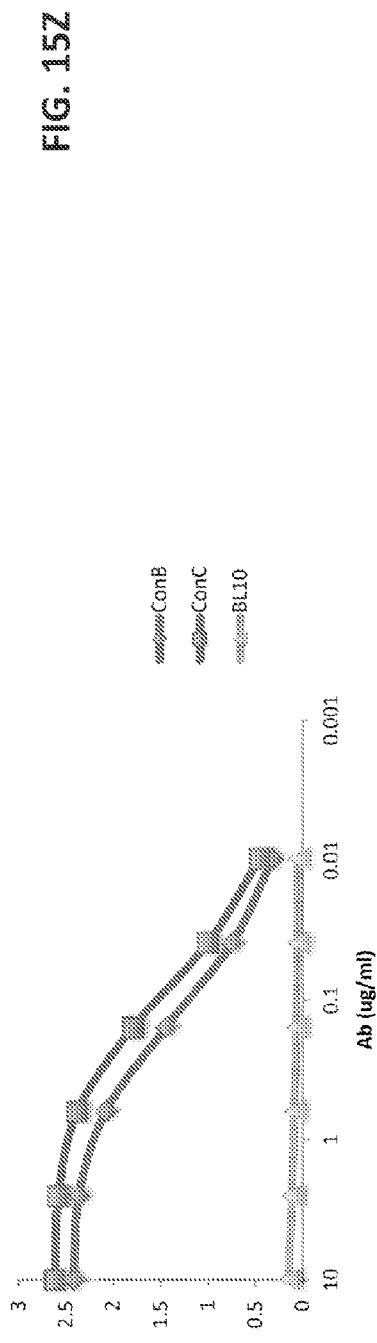
Figure 15A:
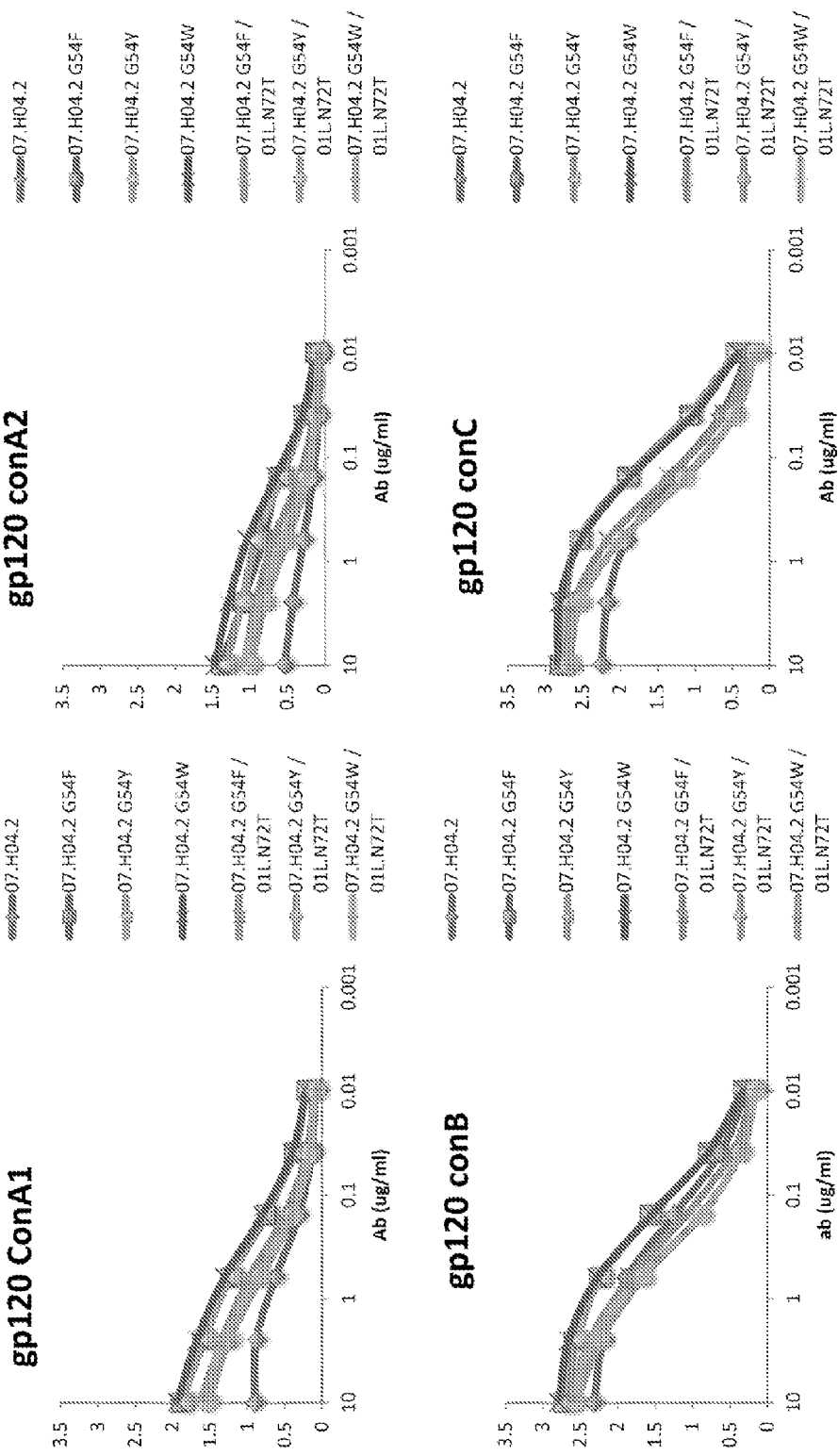
Figure 15F:
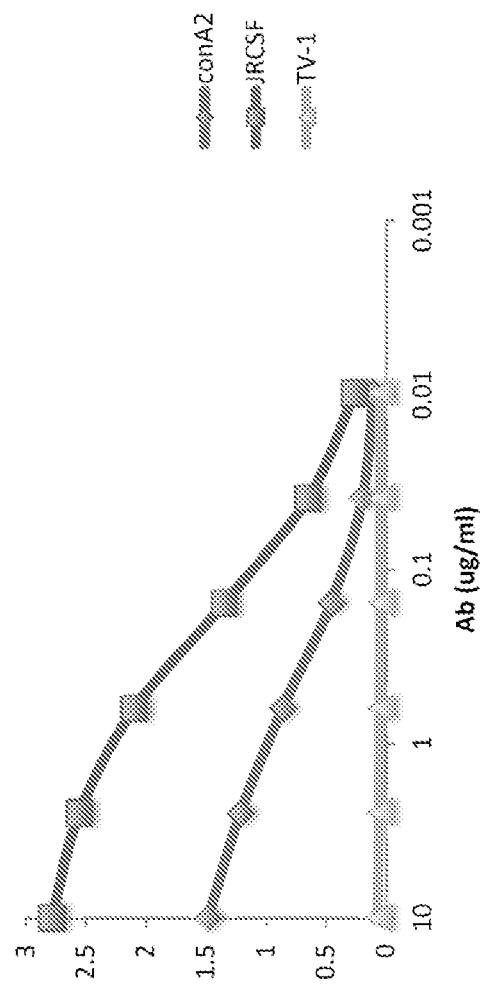
Figure 15J:
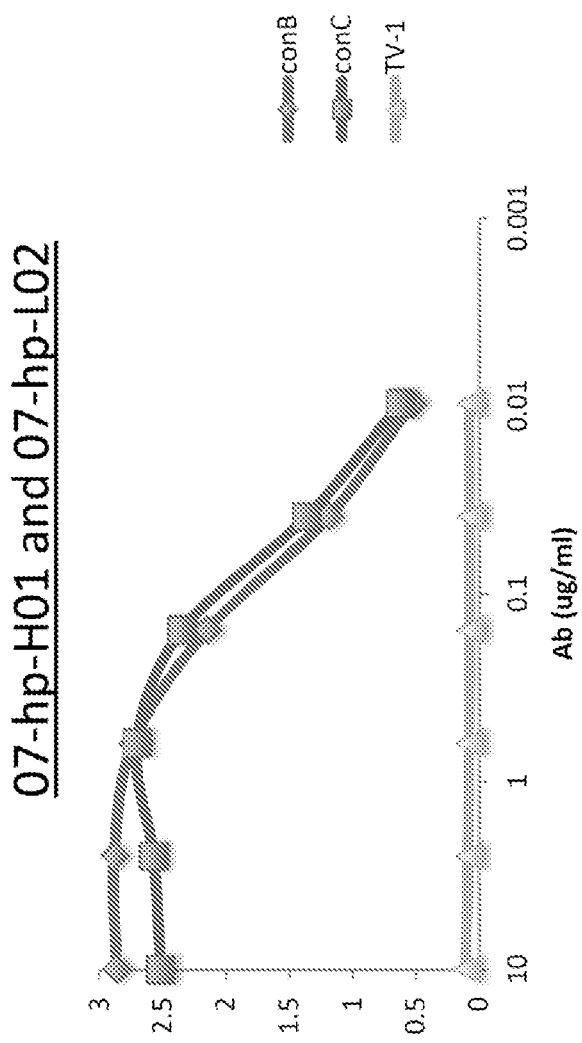

FIGS. 15A-15LL are a series of graphs illustrating the results of ELISA measurements of binding of the indicated monoclonal antibodies to the indicated gp120 proteins ("con" stands for consensus sequence). The heavy and light chains for each antibody are listed on top of each graph. The y-axis is OD at 450 nm and the x-axis is antibody concentration in μg/ml. The assay was performed in duplicate and values shown are an average. Antibody heavy and light chain pairings chosen for further neutralization studies are underlined. For FIGS. 15V-15W, "07" is an abbreviation for "VRC07" and all heavy chains were paired with VRC01 light chain). For FIGS. 15X-15EE, "07" is an abbreviation for "VRC07ghv," "01L" is an abbreviation for VRC01 light chain, and if no light chain is listed, VRC01 light chain was the light chain used.

Figure 16A:
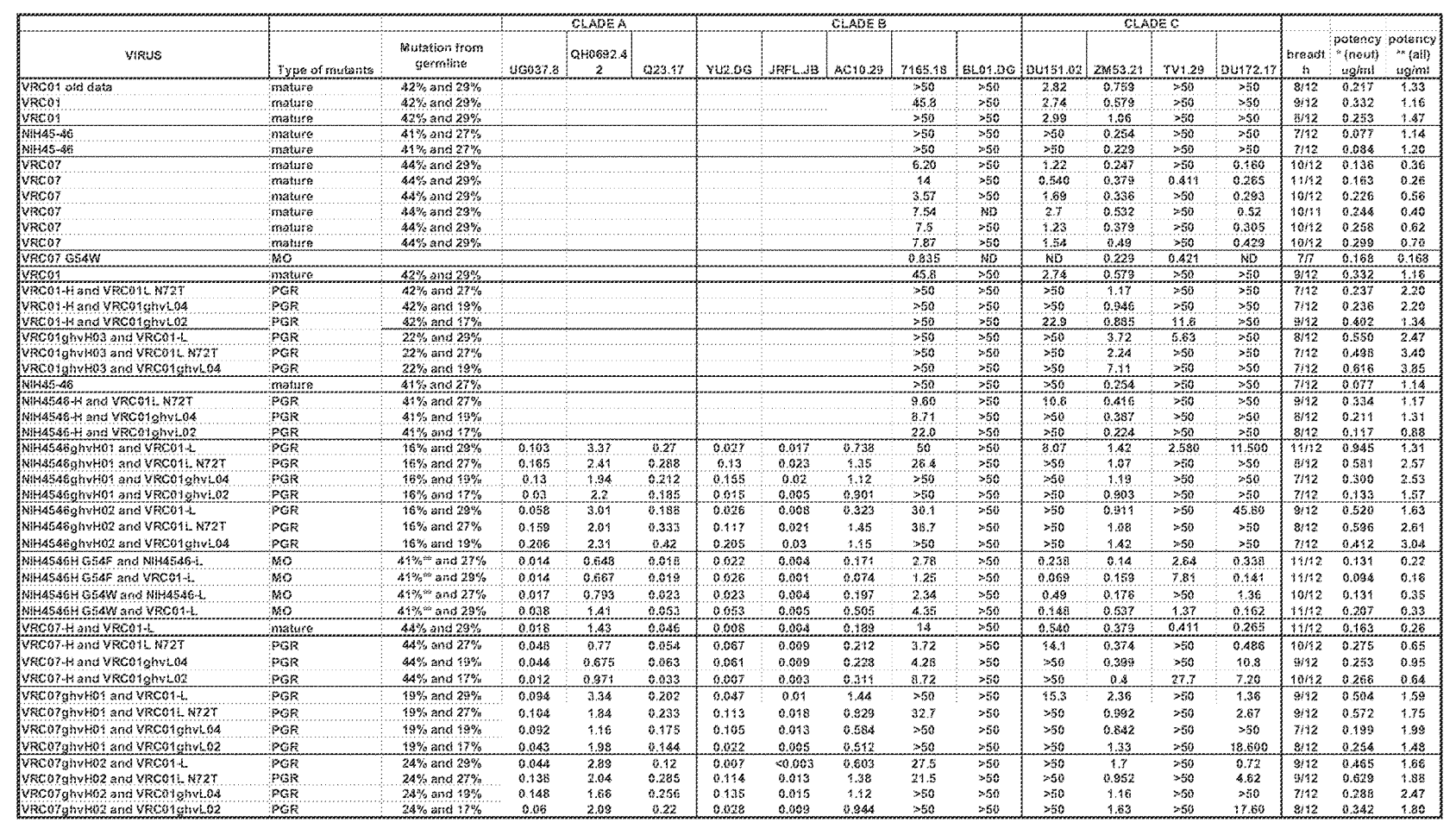
Figure 16B:
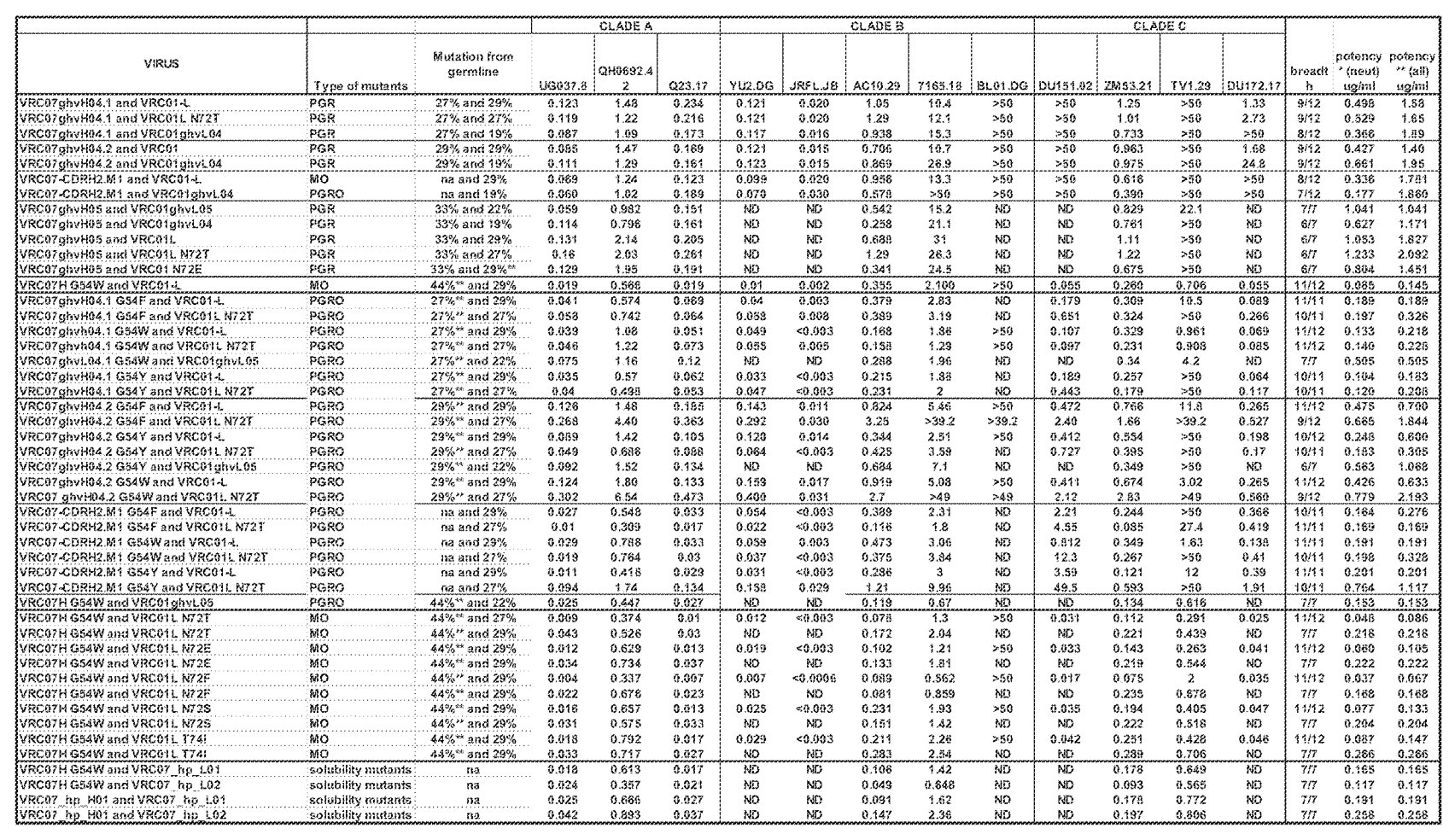

FIGS. 16A-16B are a set of tables showing the results of HIV-1 neutralization assays performed using monoclonal antibodies formed from the indicated heavy and light chains.

Figure 17:
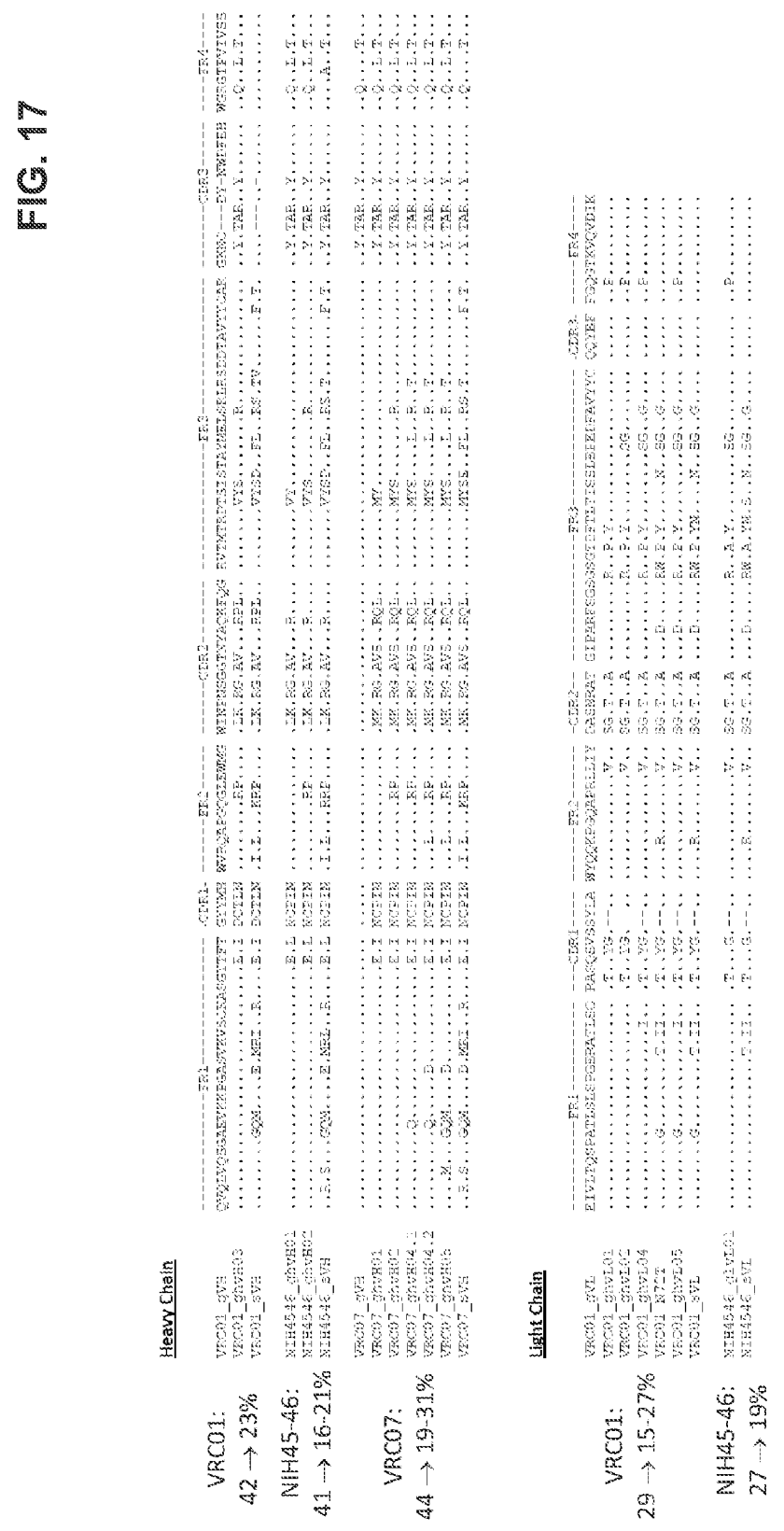

FIG. 17 shows a sequence alignment illustrating the partial germline reversion and mutants of heavy chains variable domains. The sequence of the following heavy chain variable domains is shown: VRC01gVH (SEQ ID NO: 198), VRC01ghvH03 (SEQ ID NO: 199), VRC01sVH (SEQ ID NO: 5), NIH4546ghvH01 (SEQ ID NO: 200), NIH4546ghvH02 (SEQ ID NO: 201) NIH4546sVH (SEQ ID NO: 196), VRC07gVH (SEQ ID NO: 202), VRC07ghvH01 (SEQ ID NO: 203), VRC07ghvH02 (SEQ ID NO: 204), VRC07ghvH04.1 (SEQ ID NO: 205), VRC07ghvH04.2 (SEQ ID NO: 206), VRC0ghvH05 (SEQ ID NO: 207), and VRC07sVH (VRC07; SEQ ID NO: 2). The sequence of the following light chain variable domains is shown: VRC01gVL (SEQ ID NO: 208), VRC01ghvL01 (SEQ ID NO: 209), VRC01ghvL02 (SEQ ID NO: 210), VRC01ghvL04 (SEQ ID NO: 211), VRC01N72T (SEQ ID NO: 212), VRC01ghvL05 (SEQ ID NO: 213), VRC01sVL (VRC01; SEQ ID NO: 9), NIH4546glvL01 (SEQ ID NO: 214), and NIH4546sVL (NIH4546; SEQ ID NO: 215).

FIG. 18 shows a sequence and a three dimensional structure illustrating the gp120 binding surface of the VRC01 monoclonal antibody and the residues of the VRC01 heavy and light chains that were selected for alanine scanning mutagenesis. VRC01 binding energy hot spots: (A) Amino acid sequence of VRC01 heavy chain variable domain (SEQ ID NO: 5). Bold letters indicate VRC01 residues contacting gp120. Single dot, double dot and triple dot below the amino acid sequence indicates positions that when mutated to alanine resulted in a significant decrease in affinity for gp120. Reduction in binding $K_D$—single dot>double dot>triple dot. Alanine mutation at Kabat position G54 of the VRC01 heavy chain resulted in almost four times increase in affinity of VRC01 to gp120 protein. (B) Structural mapping of important contact residues on VRC01-heavy and light chains. Light to medium grey indicates a reduction in binding affinity. White indicates no change in binding. Dark grey indicates an increase in binding $K_D$.

FIGS. 19A-19C are a series of tables presenting affinity measurements for VRC01 monoclonal antibody (containing the indicated alanine substitution) binding to gp120 analyte RSC3 (FIG. 19A), gp120 from HIV-1 strain YU2 (FIG. 19B), and gp120 from HIV-1 strain ZM109 (FIG. 19C). The calculated $K_D$ is indicated.

Figure 20:
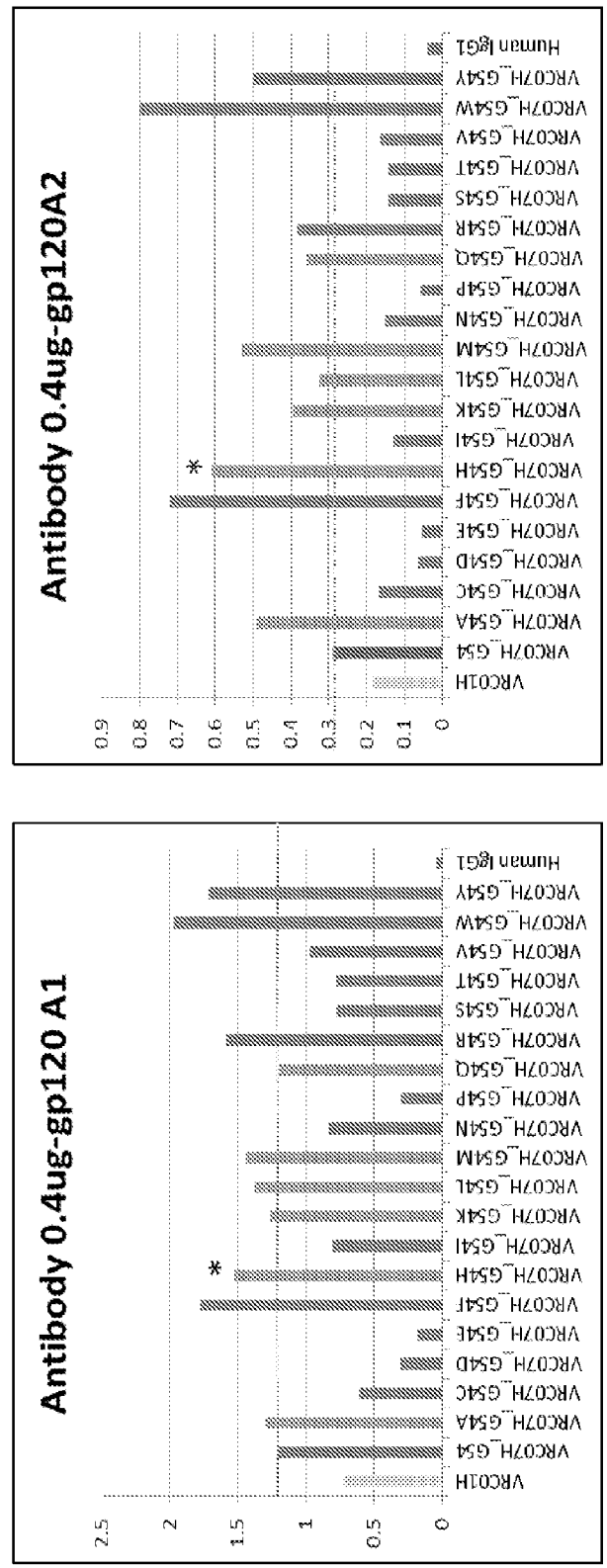

FIG. 20 is a set of bar graphs of an ELISA for VRC07 G54 heavy chain variants (the VRC07 G54 variant was complemented with VRC01 light chain). In addition to G54F, G54R, G54W, and G54Y, which showed improved binding to Glade A gp120s, G54A, G54H, G54K, G54M, and G54Q showed enhanced binding to two Glade A viruses tested; among them, G54H showed most improved biding to the gp120s.

Figure 21:
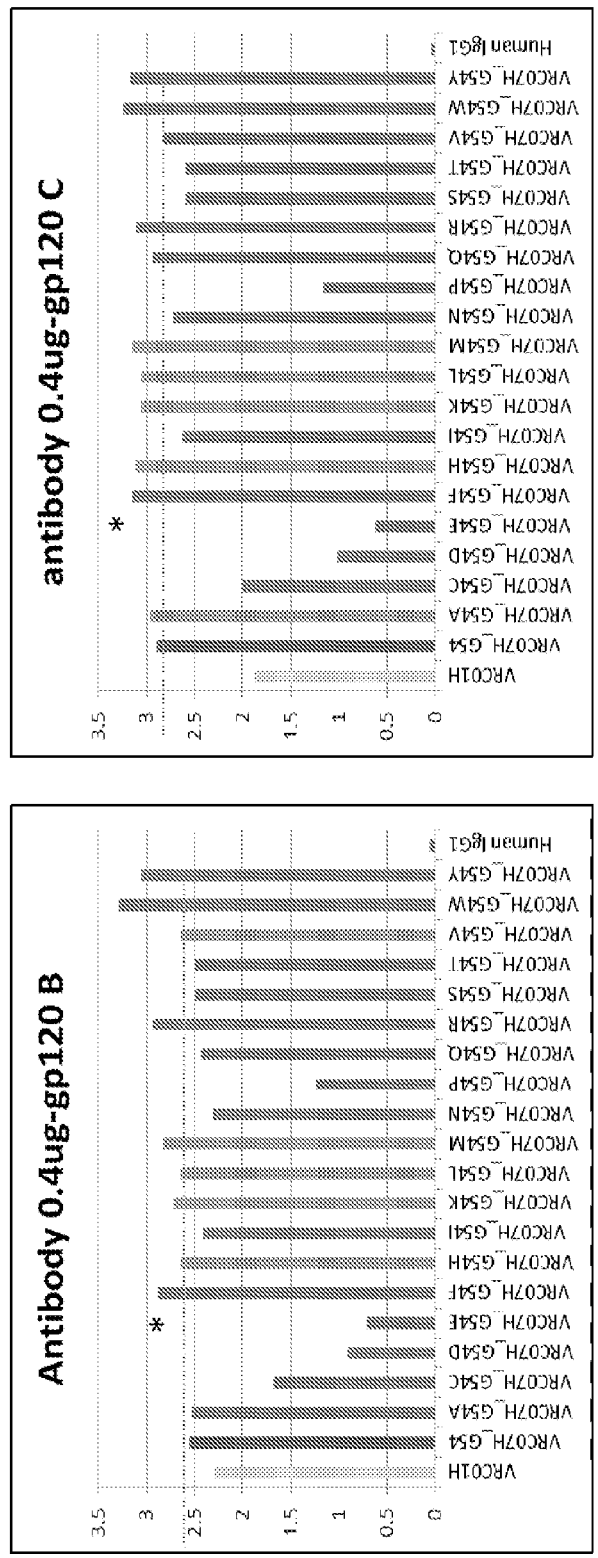

FIG. 21 is a set of bar graphs of an ELISA for VRC07 G54 heavy chain variants (the VRC07 G54 variant was complemented with VRC01 light chain). In addition to G54F, G54R, G54W, and G54Y, which showed improved binding to Glade B gp120s, G54A, G54H, G54K, G54M, G54Q, and G54V showed enhanced binding to a Glade B or a Glade C virus.

Figure 22:
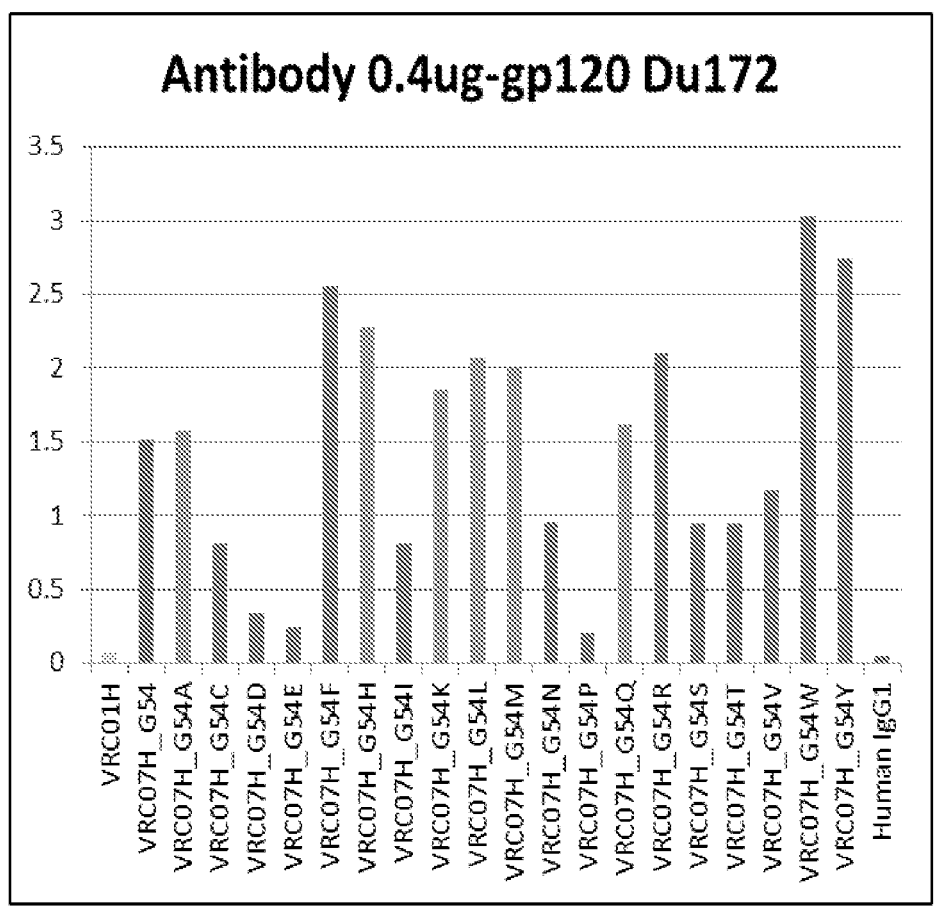

FIG. 22 is a bar graph of an ELISA for VRC07 G54 heavy chain variants (the VRC07 G54 variant was complemented with VRC01 light chain). In addition to G54F, G54R, G54W, and G54Y, which showed improved binding to Du172 gp120s, G54A, G54H, G54K, G54M, and G54Q showed enhanced binding to the virus. Among them, G54H showed most improved biding to the gp120 that is resistant to VRC01.

FIG. 23 is a table showing results from anti-cardiolipin assays of the indicated monoclonal antibodies. Anti-cardiolipin assays are used to indicate if an antibody is self-reactive. VRC07 heavy chain and the indicated variant VRC07 heavy chains were complemented with VRC01 light chain to form functional antibodies. The results indicate that a monoclonal antibody including the VRC07 G54H heavy chain variable domain and the VRC01 light chain variable domain is not autoreactive.

FIG. 24 is a set of tables showing results of neutralization experiments using antibodies including the indicated heavy and light chain variable domains. The results indicate that an antibody including the VRC07 G54H variant heavy chain complemented with VRC01 light chain increased neutralization potency >2 fold compared to VRC07 heavy chain complemented with VRC01 light chain. Thus, in a TZM-bl neutralization assay, VRC07 G54H neutralizes the selected viruses more potently than VRC07. The estimated fold improvement over VRC07 is about 2.3 and 2.5 fold when their geometric means of IC50 and IC80, respectively, are compared.

FIG. 25 shows a nucleic acid sequence encoding the VRC07 G54H heavy chain variable domain (SEQ ID NO: 37) and the amino acid sequence of the VRC07 G54H heavy chain variable domain (SEQ ID NO: 32).

FIG. 26 is a schematic diagram showing design of partially-reverted antibody variants.

Figure 27:
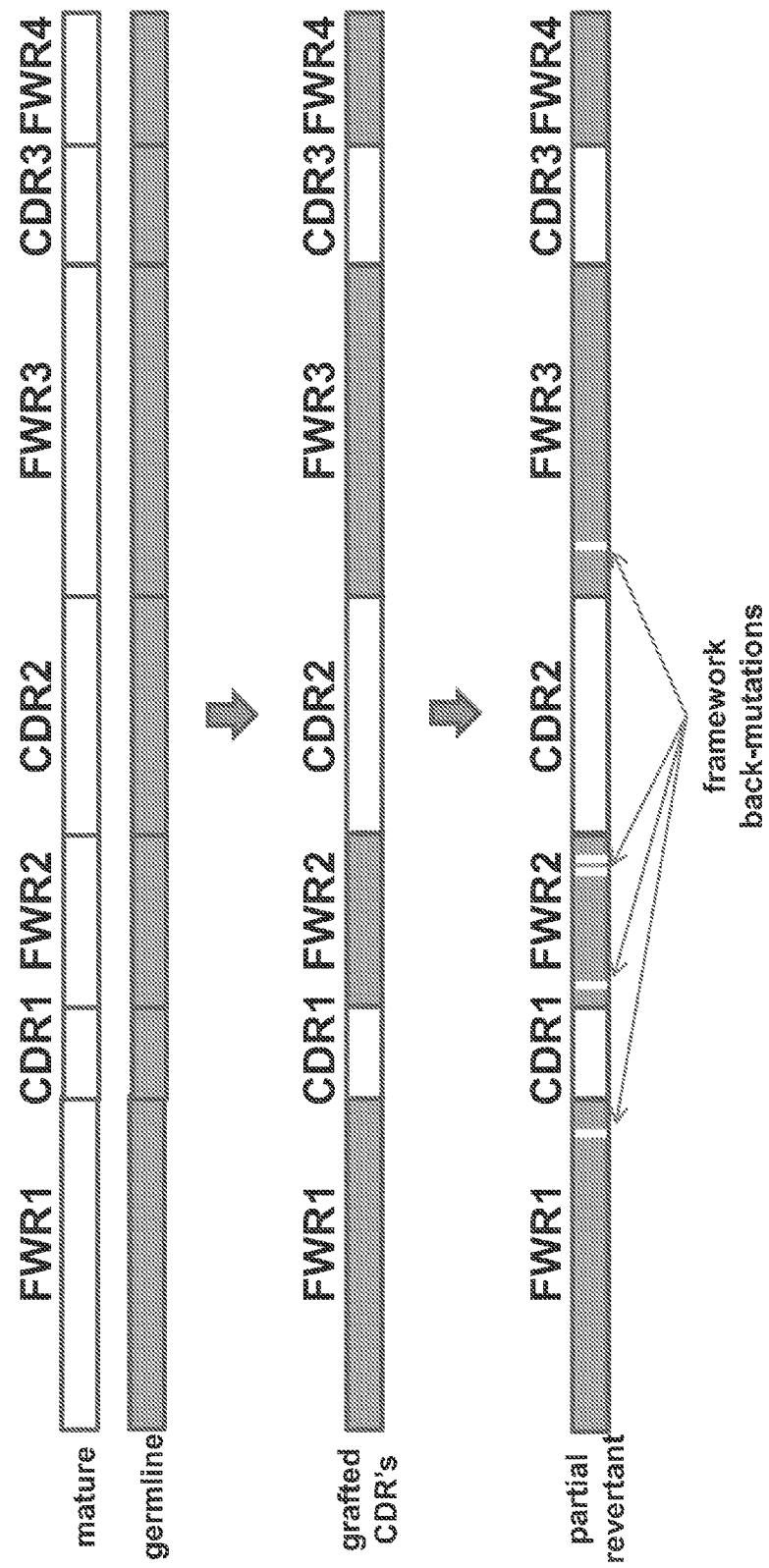

FIG. 27 is a schematic diagram showing the design of partially-reverted antibody variants by CDR grafting.

Figure 28:
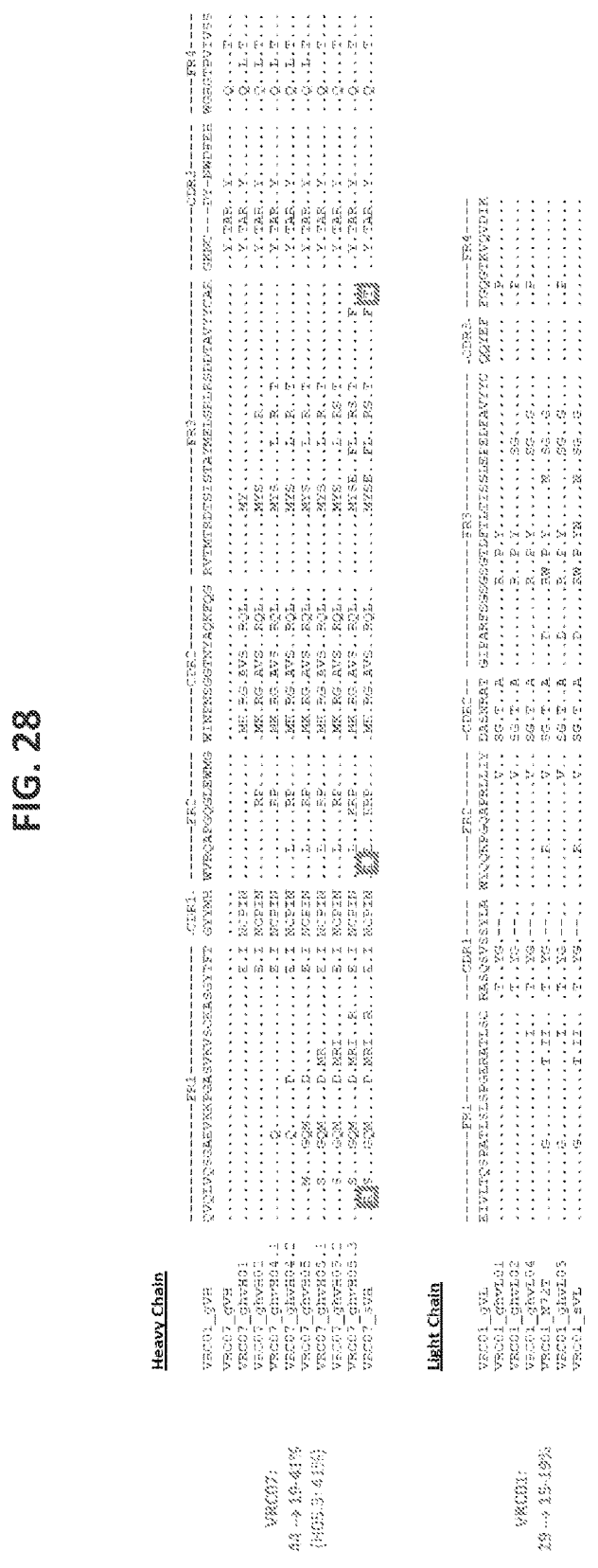

FIG. 28 shows the sequences of partial revertants of VRC07 heavy chain and VRC01 light chain. The sequence of the following heavy chain variable domains is shown: VRC01gVH (SEQ ID NO: 198), VRC07gVH (SEQ ID NO: 202), VRC07ghvH01 (SEQ ID NO: 203), VRC07ghvH02 (SEQ ID NO: 204), VRC07ghvH04.1 (SEQ ID NO: 205), VRC07ghvH04.2 (SEQ ID NO: 206), VRC07ghvH05 (SEQ ID NO: 207), VRC07ghvH05.1 (SEQ ID NO: 216), VRC07ghvH05.2 (SEQ ID NO: 217), VRC07ghvH05.3 (SEQ ID NO: 218), and VRC07sVH (SEQ ID NO: 2). The sequence of the following light chain variable domains is shown: VRC01gVL (SEQ ID NO: 208), VRC01ghvL01 (SEQ ID NO: 209), VRC01ghvL02 (SEQ ID NO: 210), VRC01ghvL04 (SEQ ID NO: 211), VRC01_N72T (SEQ ID NO: 212), VRC01ghvL05 (SEQ ID NO: 213), and VRC01sVL (VRC01; SEQ ID NO: 9).

FIG. 29 is a table showing results of neutralization experiments using antibodies including the indicated heavy and light chains. VRC07ghvH05.3 refers to VRC07 heavy chain with R3Q, I37V, and T93A amino acid substitutions. VRC07ghvH05.3.1 refers to VRC07 heavy chain with I37C and T93A amino acid substitutions. VRC01-EI-del refers to VRC01 light chain with the first two amino acids (E1 and I2) deleted.

Figure 30:
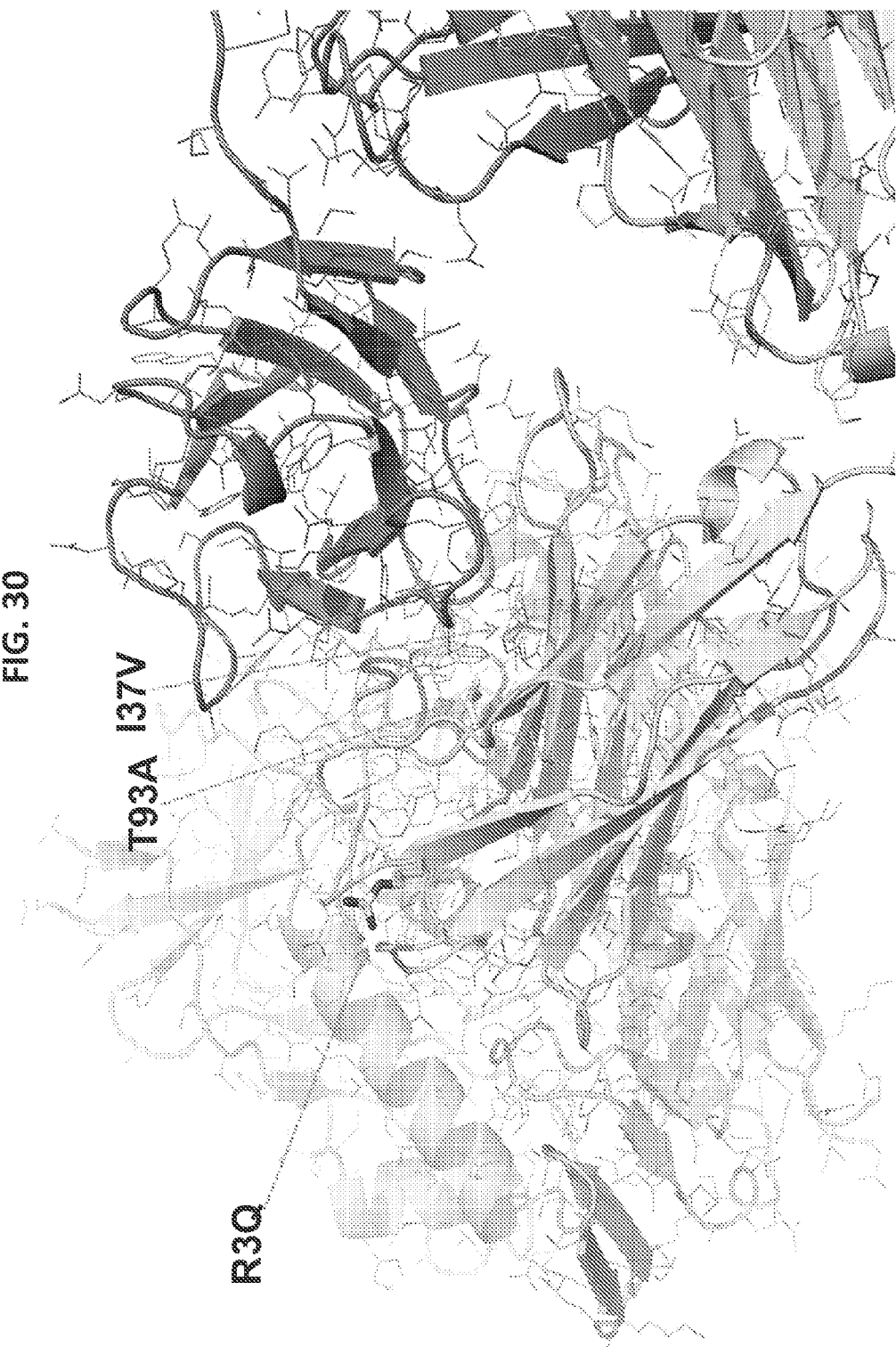
Figure 31:
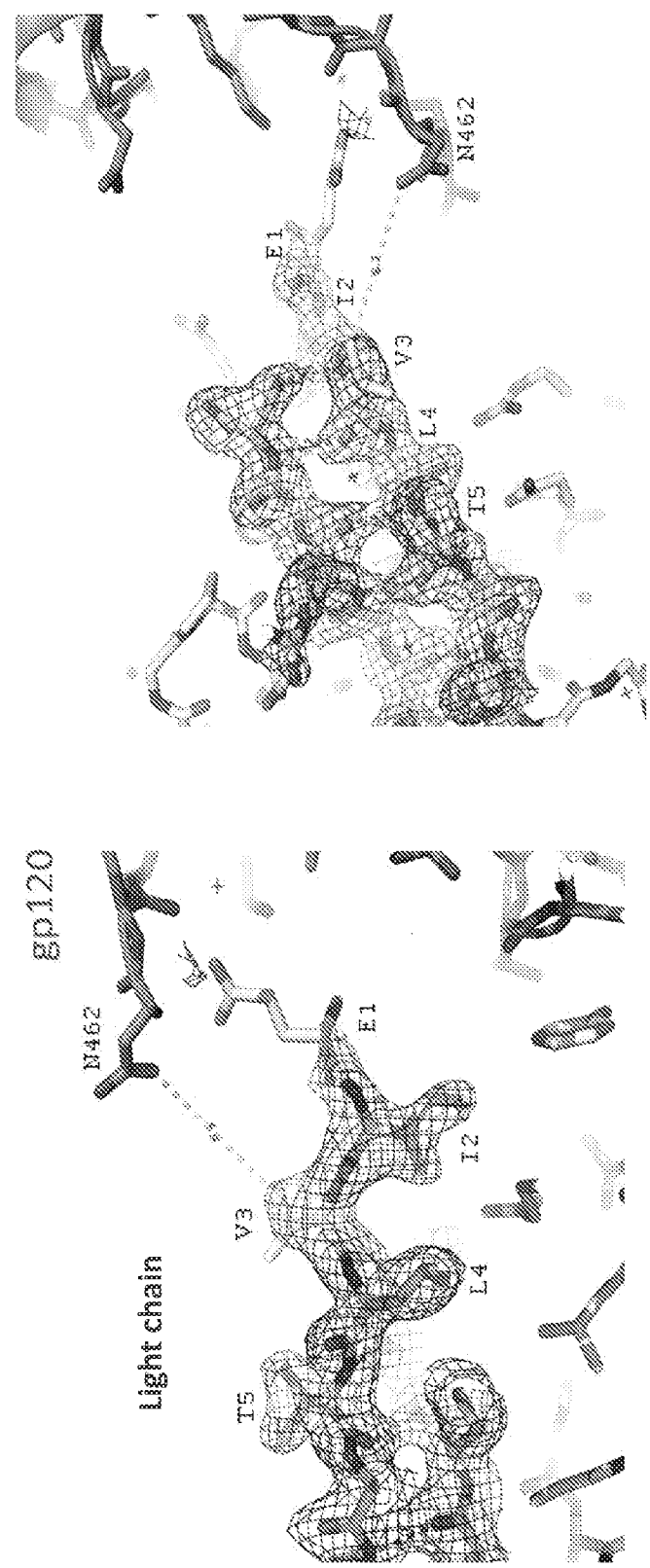

FIG. 30 is a ribbon diagram of VRC07ghvH05.3 showing the R3Q, I37V, and T93A amino acid substitutions FIG. 31 is a schematic diagram illustrating the deletion of the first two amino acids from the VRC01 light chain.

FIG. 32 is a table listing the VRC01/07 light chain variants.

Figure 33:
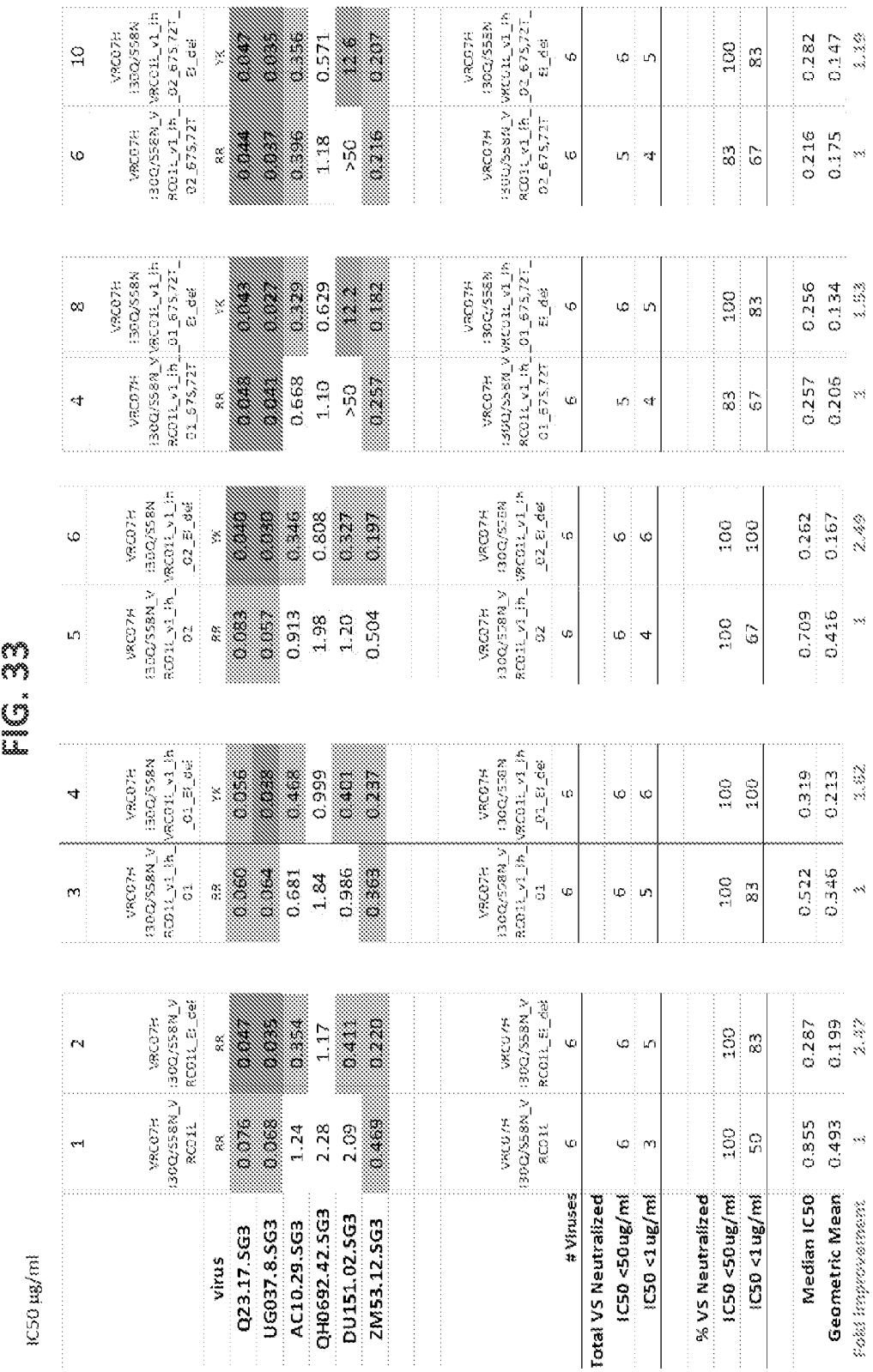

FIG. 33 is a table showing results of neutralization experiments using antibodies including the indicated heavy and light chains. The results indicate the increased potency achieved with deletion of the first two amino acids of the light chain variable domain.

Figure 34:
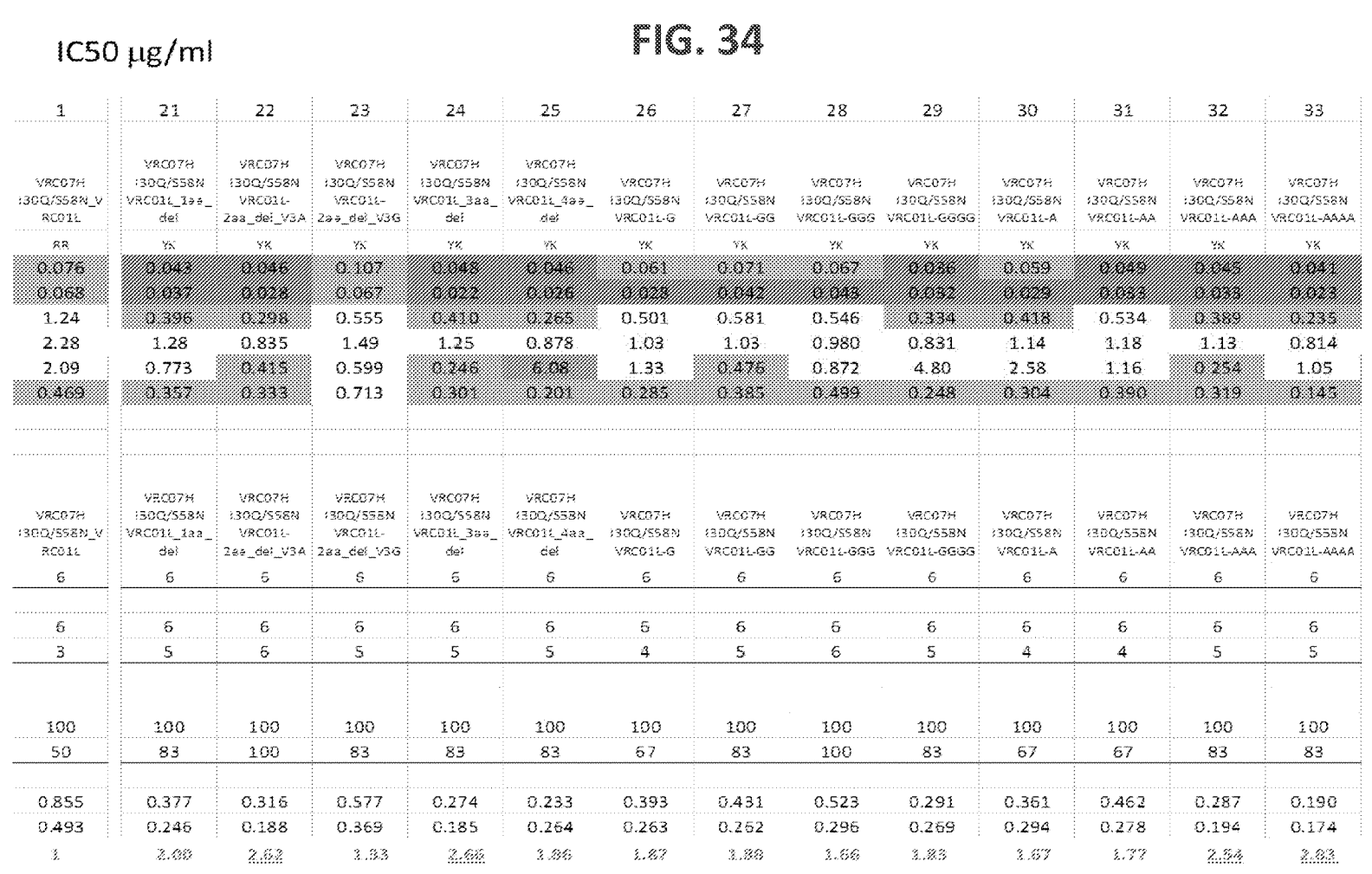

FIG. 34 is a table showing results of neutralization experiments using antibodies including the indicated heavy and light chains. The results indicate the increased potency achieved with deletion of the first two amino acids of the light chain variable domain.

SEQUENCE LISTING

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file in the form of the file named "Sequence.txt" (~750 kb), which was created on Nov. 23, 2015, which is incorporated by reference herein. In the accompanying sequence listing:

SEQ ID NO: 1 is the amino acid sequence of the consensus heavy chain variable domain of the VRC07, VRC07b and VRC07c gp120 specific monoclonal antibodies with and without certain amino acid substitutions at positions I30, G54 and S58 (Kabat numbering).

QVRLSQSGGQX$_1$[11]KKPGDSMRISCRASGYX$_2$[28]FX$_{12}$[30]NCPINWIRLAPGX$_3$[43]RPEWMGWX$_4$[51]KPRX$_{13}$[55]GAVX$_5$[59]YARQX$_6$[64]QGRVT-MTRDX$_7$[74]YSX$_8$[77]TAFLELRX$_9$[85]LTSDD-TAVYFCTR GKYCTARDYYNWDFEHWGX$_{10}$[117]GTX$_{11}$[120]VTVSS, wherein X$_1$ is M or V, X$_2$ is E or D, X$_3$ is K or R, X$_4$ is M or V, X$_5$ is N or S, X$_6$ is L or F, X$_7$ is M or V, X$_8$ is E or D, X$_9$ is S, A or P, X$_{10}$ is Q or R and X$_{11}$ is P or L, X$_{12}$ is I, R or Q, X$_{13}$ is A, H, K, M, Q, V, G, F, R, Y or W.

SEQ ID NO: 2 is the amino acid sequence of the heavy chain variable domain of gp120-specific antibody VRC07.

SEQ ID NO: 3 is the amino acid sequence of the heavy chain variable domain of gp120-specific antibody VRC07b.

SEQ ID NO: 4 is the amino acid sequence of the heavy chain variable domain of gp120-specific antibody VRC07c.

SEQ ID NO: 5 is the amino acid sequence of the heavy chain variable domain of gp-120 specific antibody VRC01.

SEQ ID NO: 6 is the amino acid sequence of the consensus light chain variable domain of the VRC01, VRC07b and VRC07c gp120-specific antibodies.

EIVLTQSPX$_1$[9]TLSLSPGEX$_2$[18]AIX$_3$[21]SCRTX$_4$[26]QYGSLAWYQQRPGQAPRLVIYX$_5$[48]GSTRAX$_6$[53]GIPDRFSGSRWGX$_7$X$_8$[68]YNLTIS-NLESX$_9$[79]DFGVYYCQQYEFFGQGTKVQVDIK, wherein X$_1$ is A or G, X$_2$ is R or T, X$_3$ is I or L, X$_4$ is S or T, X$_5$ is S or A, X$_6$ is A or T, X$_7$ is A or P, X$_8$ is E or D, and X$_9$ is E or G.

SEQ ID NO: 7 is the amino acid sequence of the light chain variable domain of gp120-specific antibody VRC07b.

SEQ ID NO: 8 is the amino acid sequence of the light chain variable domain of gp120-specific antibody VRC07c.

SEQ ID NO: 9 is the amino acid sequence of the light chain variable domain of gp120-specific antibody VRC01.

SEQ ID NO: 10 is an exemplary nucleic acid sequence encoding the heavy chain variable domain of gp120-specific antibody VRC07.

SEQ ID NO: 11 is an exemplary nucleic acid sequence encoding the heavy chain variable domain of gp120-specific antibody VRC07b.

SEQ ID NO: 12 is an exemplary nucleic acid sequence encoding the heavy chain variable domain of gp120-specific antibody VRC07c.

SEQ ID NO: 13 an exemplary nucleic acid sequence encoding the heavy chain variable domain of gp-120 specific antibody VRC01.

SEQ ID NO: 14 is an exemplary nucleic acid sequence encoding the light chain variable domain of gp120-specific antibody VRC07b.

SEQ ID NO: 15 is an exemplary nucleic acid sequence encoding the light chain variable domain of gp120-specific antibody VRC07c.

SEQ ID NO: 16 is an exemplary nucleic acid sequence encoding the light chain variable domain of gp120-specific antibody VRC01.

SEQ ID NO: 17 is the nucleic acid sequence of a nucleic acid primer.

SEQ ID NO: 18 is the nucleic acid sequence of a nucleic acid primer.

SEQ ID NO: 19 is the nucleic acid sequence of a nucleic acid primer.

SEQ ID NO: 20 is the nucleic acid sequence of a nucleic acid primer.

SEQ ID NO: 21 is the nucleic acid sequence of a nucleic acid primer.

SEQ ID NO: 22 is the nucleic acid sequence of a nucleic acid primer.

SEQ ID NO: 23 is the amino acid sequence of the consensus heavy chain variable domain for VRC07 gp120 specific monoclonal antibodies with certain amino acid substitutions at positions I30, G54 and S58 (Kabat numbering).

QVRLSQSGGQMKKPGDSMRISCRASGYEFX$_1$[30]
NCPINWIRLAPGKRPEWMGWMKPRX$_2$[55]
GAVX$_3$ [59]YARQLQGRVTMTRDMYSETAFLEL-
RSLTSDDTAVYFCTRGKYCTARDYYNWDFE
HWGQGTPV TVSS, wherein X$_1$ is I, R or Q, X$_2$ is G, F, R, Y or W and X$_3$ is S or N.

SEQ ID NO: 24 is the amino acid sequence of the heavy chain variable domain of gp120-specific antibody VRC07 G54W, I30Q.

SEQ ID NO: 25 is the amino acid sequence of the heavy chain variable domain of gp120-specific antibody VRC07 G54W, I30R.

SEQ ID NO: 26 is the amino acid sequence of the heavy chain variable domain of gp120-specific antibody VRC07 G54W, S58N.

SEQ ID NO: 27 is the amino acid sequence of the light chain variable domain of the gp120-specific antibody VRC01 N72A.

SEQ ID NO: 28 is the amino acid sequence of the heavy chain variable domain of gp120-specific antibody VRC07 G54W.

SEQ ID NO: 29 is the amino acid sequence of the consensus heavy chain of the VRC07, VRC07b and VRC07c gp120 specific antibodies.

QVRLSQSGGQX$_1$[11]KKPGDSMRISCRASGYX$_2$[28]
FINCPINWIRLAPGX$_3$[43]RPEWMGWX$_4$[51]KPR
GGAVX$_5$[59]YARQX$_6$[64]QGRVTMTRDX$_7$[74]
YSX$_8$[77]TAFLELRX$_9$[85]LTSDDTAVYFCTRG-
KYCTA RDYYNWDFEHWGX$_{10}$[117]GTX$_{11}$[120]
VTVSS, wherein X$_1$ is M or V, X$_2$ is E or D, X$_3$ is K or R, X$_4$ is M or V, X$_5$ is N or S, X$_6$ is L or F, X$_7$ is M or V, X$_8$ is E or D, X$_9$ is S, A or P, X$_{10}$ is Q or R and X$_{11}$ is P or L.

SEQ ID NO: 30 is the amino acid sequence of the heavy chain variable domain of the gp120 specific antibody VRC07 with a A, F, H, K, M, Q, R, V, W, or Y amino acid substitution at Kabat position G54.

SEQ ID NO: 31 is the amino acid sequence of the heavy chain variable domain of the gp120 specific antibody VRC07 G54A.

SEQ ID NO: 32 is the amino acid sequence of the heavy chain variable domain of the gp120 specific antibody VRC07 G54H.

SEQ ID NO: 33 is the amino acid sequence of the heavy chain variable domain of the gp120 specific antibody VRC07 G54K.

SEQ ID NO: 34 is the amino acid sequence of the heavy chain variable domain of the gp120 specific antibody VRC07 G54M.

SEQ ID NO: 35 is the amino acid sequence of the heavy chain variable domain of the gp120 specific antibody VRC07 G54Q.

SEQ ID NO: 36 is the amino acid sequence of the heavy chain variable domain of the gp120 specific antibody VRC07 G54V.

SEQ ID NO: 37 is a nucleic acid sequence encoding VRC07 G54H (see FIG. 25).

SEQ ID NO: 38 is the amino acid sequence of a consensus VRC07 heavy chain with partial germline reversions.

SEQ ID NO: 39 is the amino acid sequence of VRC07 heavy chain with three amino acids reverted to the germline.

SEQ ID NO: 40 is the consensus amino acid sequence of a heavy chain of VRC07 with amino acid substitutions at one or more of positions I37, G54, S58, and T93 (Kabat numbering).

SEQ ID NO: 41 is the amino acid sequence of a consensus VRC07 light chain.

X$_1$X$_2$VLTQSPGTLSLSPGETAX$_3$ISCRTSQYGSLAWYQQRPGQAPRLVIY

SGSTRAAGIPDRFSGSRX$_4$GPDYX$_5$LTISNLESGDFGVYYCQQYEFFGQG

TKVQX$_6$DX$_7$K wherein X$_1$ is E or no amino acid, X$_2$ is I or no amino acid, wherein X$_3$ is T or I, X$_4$ is W or S, X$_5$ is N or T, X$_6$ is V or Q, and X$_7$ is I or N.

SEQ ID NO: 42 is the amino acid sequence of a consensus VRC07 light chain.

X$_1$X$_2$X$_3$X$_4$TQSPGTLSLSPGETAIISCRTSQYGSLAWYQQRPGQAPRLVI

YSGSTRAAGIPDRFSGSRWGPDYX$_5$LTISNLESGDFGVYYCQQYELLGQG

TKVQVDIK wherein X$_1$ is E, G, A or no amino acid, X$_2$ is I, G, A, or no amino acid, X$_3$ is V, G, A or no amino acid, X$_4$ is L, G, A or no amino acid and X$_5$ is N, F or T.

SEQ ID NO: 43 is the consensus amino acid sequence of a light chain variable domain.

SEQ ID NO: 44 is the consensus amino acid sequence of a light chain variable domain.

SEQ ID NO: 45 is the amino acid sequence of a peptide.
SEQ ID NO: 46 is the amino acid sequence of a peptide.
SEQ ID NO: 47 is the amino acid sequence of a peptide.
SEQ ID NO: 48 is the amino acid sequence of a peptide linker SEQ ID NO: 49 is the nucleotide sequence of an oligonucleotide.

SEQ ID NO: 50 is the amino acid sequence of the VRC01hpL02 light chain variable domain.

SEQ ID NO: 51 is the amino acid sequence of the VRC01ghvL05 light chain variable domain.

SEQ ID NO: 53 is the amino acid sequence of the VRC01 light chain variable domain with deletion of the E1 and I2 amino acids.

SEQ ID NO: 54 is the amino acid sequence of the VRC01 light chain variable domain with deletion of the E1 and I2 amino acids, and a N72T amino acid substitution.

SEQ ID NO: 55 is the amino acid sequence of the VRC01hpL02 light chain variable domain.

SEQ ID NO: 56 is the amino acid sequence of the VRC01hpL02 light chain variable domain with deletion of the E1 and I2 amino acids.

SEQ ID NOs: 57-100 are the nucleotide sequences of plasmids and plasmid inserts encoding VRC07 heavy chain variants, as indicated in Table 2.

SEQ ID NOs: 101-108 are the nucleotide and protein sequences of VRC07 heavy chain variants, as indicated in Table 3.

SEQ ID NOs: 109-194 are the nucleotide sequences of plasmids and plasmid inserts encoding VRC07 heavy chain and VRC01 light chain variants, as indicated in Table 2.

SEQ ID NO: 195 is the amino acid sequence of IGHV1-2*02 germline. SEQ ID NO: 196 is the amino acid sequence of the heavy chain variable domain of VRC4546.

SEQ ID NO: 197 is the amino acid sequence of the heavy chain variable domain of VRC02.

SEQ ID NO: 198 is the amino acid sequence of VRC01 heavy chain germline sequence (VRC01_gVH).

SEQ ID NO: 199 is the amino acid sequence of the VRC01_ghvH03 heavy chain variable domain.

SEQ ID NO: 200 is the amino acid sequence of the VRC4546ghvH01 heavy chain variable domain.

SEQ ID NO: 201 is the amino acid sequence of the VRC4546ghvH02 heavy chain variable domain.

SEQ ID NO: 202 is the amino acid sequence of the VRC07_gVH germline sequence.

SEQ ID NO: 203 is the amino acid sequence of the VRC07ghvH01 heavy chain variable domain.

SEQ ID NO: 204 is the amino acid sequence of the VRC07ghvH02 heavy chain variable domain.

SEQ ID NO: 205 is the amino acid sequence of the VRC07ghvH04.1 heavy chain variable domain.

SEQ ID NO: 206 is the amino acid sequence of the VRC07ghvH04.2 heavy chain variable domain.

SEQ ID NO: 207 is the amino acid sequence of the VRC07ghvH05 heavy chain variable domain.

SEQ ID NO: 208 is the amino acid sequence of the VRC01gVL germline.

SEQ ID NO: 209 is the amino acid sequence of the VRC01ghvL01 light chain variable domain.

SEQ ID NO: 210 is the amino acid sequence of the VRC01ghvL02 light chain variable domain.

SEQ ID NO: 211 is the amino acid sequence of the VRC01ghvL04 light chain variable domain.

SEQ ID NO: 212 is the amino acid sequence of the VRC01N72T light chain variable domain.

SEQ ID NO: 213 is the amino acid sequence of the VRC01ghvL05 light chain variable domain.

SEQ ID NO: 214 is the amino acid sequence of the VRC4546ghvL01 light chain variable domain.

SEQ ID NO: 215 is the amino acid sequence of the VRC4546L light chain variable domain.

SEQ ID NO: 216 is the amino acid sequence of the VRC07ghvH05.1 heavy chain variable domain.

SEQ ID NO: 217 is the amino acid sequence of the VRC07ghvH05.2 heavy chain variable domain.

SEQ ID NO: 218 is the amino acid sequence of the VRC07ghvH05.3 heavy chain variable domain.

SEQ ID NO: 219 is the amino acid sequence of the VRC01 E1/I2del V3E light chain variable domain.

SEQ ID NO: 220 is the amino acid sequence of the VRC01 E1/I2del V3K light chain variable domain.

SEQ ID NO: 221 is the amino acid sequence of the VRC01 E1/I2del V3S light chain variable domain.

SEQ ID NO: 222 is the amino acid sequence of the VRC01 E1/I2del F97D light chain variable domain.

SEQ ID NO: 223 is the amino acid sequence of the VRC01 E1/I2del F97K light chain variable domain.

SEQ ID NO: 224 is the amino acid sequence of the VRC01 E1/I2del F97S light chain variable domain.

SEQ ID NO: 225 is the amino acid sequence of the VRC01 E1/I2del F97H light chain variable domain.

SEQ ID NO: 226 is the amino acid sequence of the VRC01 E1/I2del V3E/F97S light chain variable domain.

SEQ ID NO: 227 is the amino acid sequence of the VRC01 E1/I2del V3E/F97H light chain variable domain.

SEQ ID NO: 228 is the amino acid sequence of the VRC01hpL03 light chain variable domain.

SEQ ID NO: 229 is the amino acid sequence of the VRC01hpL04 light chain variable domain.

SEQ ID NO: 230 is the amino acid sequence of the VRC01hpL05 light chain variable domain.

SEQ ID NO: 231 is the amino acid sequence of the VRC01hpL06 light chain variable domain.

SEQ ID NO: 232 is the amino acid sequence of the VRC01hpL02 E1/I2del V3S light chain variable domain.

SEQ ID NO: 233 is the amino acid sequence of the VRC01 hpL03 E1/I2del V3S light chain variable domain.

SEQ ID NO: 234 is the amino acid sequence of the VRC01 hpL04 E1/I2del V3S light chain variable domain.

SEQ ID NO: 235 is the amino acid sequence of the VRC01hpL05 E1/I2del V3S light chain variable domain.

SEQ ID NO: 236 is the amino acid sequence of the VRC01hpL06 E1/I2del V3S light chain variable domain.

SEQ ID NO: 237 is the amino acid sequence of the VRC01hpL04 E1/I2del V3E light chain variable domain.

SEQ ID NO: 238 is a consensus amino acid sequence of the VRC01 light chain variable domain with one or more amino acid substitutions or deletions.

SEQ ID NO: 239 is the amino acid sequence of an antibody light chain including the VRC01 E1/I2del V3E light chain variable domain.

SEQ ID NO: 240 is the amino acid sequence of an antibody light chain including the VRC01 E1/I2del V3K light chain variable domain.

SEQ ID NO: 241 is the amino acid sequence of an antibody light chain including the VRC01 E1/I2del V3S light chain variable domain.

SEQ ID NO: 242 is the amino acid sequence of an antibody light chain including the VRC01 E1/I2del F97D light chain variable domain.

SEQ ID NO: 243 is the amino acid sequence of an antibody light chain including the VRC01 E1/I2del F97K light chain variable domain.

SEQ ID NO: 244 is the amino acid sequence of an antibody light chain including the VRC01 E1/I2del F97S light chain variable domain.

SEQ ID NO: 245 is the amino acid sequence of an antibody light chain including the VRC01 E1/I2del F97H light chain variable domain.

SEQ ID NO: 246 is the amino acid sequence of an antibody light chain including the VRC01 E1/I2del V3E/F97S light chain variable domain.

SEQ ID NO: 247 is the amino acid sequence of an antibody light chain including the VRC01 E1/I2del V3E/F97H light chain variable domain.

SEQ ID NO: 248 is the amino acid sequence of an antibody light chain including the VRC01hpL03 light chain variable domain.

SEQ ID NO: 249 is the amino acid sequence of an antibody light chain including the VRC01hpL04 light chain variable domain.

SEQ ID NO: 250 is the amino acid sequence of an antibody light chain including the VRC01hpL05 light chain variable domain.

SEQ ID NO: 251 is the amino acid sequence of an antibody light chain including the VRC01hpL06 light chain variable domain.

SEQ ID NO: 252 is the amino acid sequence of an antibody light chain including the VRC01hpL02 E1/I2del V3S light chain variable domain.

SEQ ID NO: 253 is the amino acid sequence of an antibody light chain including the VRC01hpL03 E1/I2del V3S light chain variable domain.

SEQ ID NO: 254 is the amino acid sequence of an antibody light chain including the VRC01hpL04 E1/I2del V3S light chain variable domain.

SEQ ID NO: 255 is the amino acid sequence of an antibody light chain including the VRC01hpL05 E1/I2del V3S light chain variable domain.

SEQ ID NO: 256 is the amino acid sequence of an antibody light chain including the VRC01hpL06 E1/I2del V3S light chain variable domain.

SEQ ID NO: 257 is the amino acid sequence of an antibody light chain including the VRC01hpL04 E1/I2del V3E light chain variable domain.

SEQ ID NO: 258 is the amino acid sequence of the VRC07 G54H S58N heavy chain variable domain.

SEQ ID NO: 259 is the amino acid sequence of the VRC07 I37V G54H T93A heavy chain variable domain.

SEQ ID NO: 260 is the amino acid sequence of the VRC07 I37V G54H S58N T93A heavy chain variable domain.

DETAILED DESCRIPTION

Broadly neutralizing HIV-1 antibodies (bNAbs), antibodies that can block infection of diverse HIV-1 strains, represent important but underdeveloped therapeutics for the prevention and treatment of AIDS. bNAbs target conserved sites of vulnerability on the HIV-1 envelope (env) such as the CD4 binding site (CD4bs). The b12 monoclonal antibody was for many years considered the prototype and optimal CD4bs bNAb, although it was only able to neutralize ~40% of HIV-1 strains. In 2010, a new group of CD4bs antibodies named VRC01, VRC02, and VRC03 was disclosed. Of these, VRC01 was the most potent and broad. In a large neutralization panel (190 viruses), VRC01 neutralized 91% of viruses with an $IC_{50}$ less than 50 µg/ml and 72% of viruses with an $IC_{50}$ less than 1 µg/ml (Wu et al., Science, 329(5993):856-861, 2010). Structural analyses have explained VRC01's high potency and breadth: VRC01 partially mimics the CD4 interaction with gp120. Specifically, the majority of the gp120 area targeted by VRC01 is the highly conserved site of initial CD4 attachment in the outer domain of gp120, which allows VRC01 to bypass conformational and glycan masking that impaired previously identified CD4bs bNAbs. Both the heavy and light chain of VRC01 contribute to the binding of gp120, with the CDRH2 providing the primary interaction, and CDRL1, CDRL3, CDRH1, and CDRH3 providing additional contact points. It has been shown that passive transfer of VRC01 protects against intrarectal or intravaginal simian-HIV (SHIV) challenge in non-human primates.

Despite the success of VRC01, there is a need for additional broadly neutralizing antibodies that can inhibit HIV infection, particularly broadly neutralizing antibodies that have increased affinity for gp120, but not increase reactivity towards self antigens, compared to VRC01.

Disclosed herein is the identification of the VC07 monoclonal antibody, which specifically binds to the CD4 binding site of the gp120 protein of HIV, and is neutralizing VRC07 is a VRC01-like monoclonal antibody, and includes a novel heavy chain ("VRC07 heavy chain") cross complemented with the light chain of the VRC01 monoclonal antibody. VRC07 has increased binding affinity for gp120, but does not have significantly increased self-reactivity, for example, compared to VRC01. Further disclosed herein are variants of the VRC07 heavy chain and the VRC01 light chain, and cross-complemented monoclonal antibodies including such variants that have increased binding affinity for gp120, but are not self-reactive or have low self reactivity compared to a control. In several embodiments, the disclosed variants of the VRC07 heavy chain and the VRC01 light chain include framework region amino acid substitutions (compared to VRC07 heavy chain or VRC01 light chain), but only include up to two amino acid substitutions in the CDRs (compared to VRC07 heavy chain or VRC01 light chain). Thus, disclosed herein is a class of monoclonal antibodies that have increased binding affinity for gp120, and are not self-reactive or have low self reactivity. In some embodiments, the disclosed antibodies further are not immunogenic, or have low immunogenicity.

The person of ordinary skill in the art will appreciate that the disclosed antibodies have utility, for example, as therapeutic agents for treatment and prevention of HIV infection I. Terms Unless otherwise noted, technical terms are used according to conventional usage. Definitions of common terms in molecular biology can be found in Benjamin Lewin, *Genes VII*, published by Oxford University Press, 1999; Kendrew et al. (eds.), *The Encyclopedia of Molecular Biology*, published by Blackwell Science Ltd., 1994; and Robert A. Meyers (ed.), *Molecular Biology and Biotechnology: a Comprehensive Desk Reference*, published by VCH Publishers, Inc., 1995; and other similar references.

As used herein, the term "comprises" means "includes." Thus, "comprising an antigen" means "including an antigen" without excluding other elements.

It is further to be understood that any and all base sizes or amino acid sizes, and all molecular weight or molecular mass values, given for nucleic acids or polypeptides are approximate, and are provided for descriptive purposes, unless otherwise indicated. Although many methods and materials similar or equivalent to those described herein can be used, particular suitable methods and materials are described below. In case of conflict, the present specification, including explanations of terms, will control. In addition, the materials, methods, and examples are illustrative only and not intended to be limiting.

To facilitate review of the various embodiments, the following explanations of terms are provided:

Administration: The introduction of a composition into a subject by a chosen route. Administration can be local or systemic. For example, if the chosen route is intravenous, the composition is administered by introducing the composition into a vein of the subject. In some examples a disclosed antibody specific for an HIV protein or polypeptide, or a nucleic acid encoding the antibody, is administered to a subject.

Agent: Any substance or any combination of substances that is useful for achieving an end or result; for example, a substance or combination of substances useful for inhibiting HIV infection in a subject. Agents include proteins, nucleic acid molecules, compounds, small molecules, organic compounds, inorganic compounds, or other molecules of interest. An agent can include a therapeutic agent (such as an anti-retroviral agent), a diagnostic agent or a pharmaceutical agent. In some embodiments, the agent is a polypeptide agent (such as a HIV-neutralizing antibody), or an anti-viral agent. The skilled artisan will understand that particular agents may be useful to achieve more than one result.

Amino acid substitution: The replacement of one amino acid in a polypeptide with a different amino acid.

Amplification: A technique that increases the number of copies of a nucleic acid molecule (such as an RNA or DNA). An example of amplification is the polymerase chain reaction, in which a biological sample is contacted with a pair of oligonucleotide primers, under conditions that allow for the hybridization of the primers to a nucleic acid template in the sample. The primers are extended under suitable conditions, dissociated from the template, and then re-annealed, extended, and dissociated to amplify the number of copies of the nucleic acid. The product of amplification can be characterized by electrophoresis, restriction endonuclease cleavage patterns, oligonucleotide hybridization or ligation, and/or nucleic acid sequencing using standard techniques. Other examples of amplification include strand displacement amplification, as disclosed in U.S. Pat. No. 5,744,311; transcription-free isothermal amplification, as disclosed in U.S. Pat. No. 6,033,881; repair chain reaction amplification, as disclosed in WO 90/01069; ligase chain reaction amplification, as disclosed in EP-A-320 308; gap filling ligase chain reaction amplification, as disclosed in U.S. Pat. No. 5,427,930; and NASBA™ RNA transcription-free amplification, as disclosed in U.S. Pat. No. 6,025,134.

Animal: Living multi-cellular vertebrate organisms, a category that includes, for example, mammals and birds. The term mammal includes both human and non-human mammals. Similarly, the term "subject" includes both human and veterinary subjects.

Antibody: A polypeptide substantially encoded by an immunoglobulin gene or immunoglobulin genes, or antigen binding fragments thereof, which specifically binds and recognizes an analyte (antigen) such as gp120 or an antigenic fragment of gp120. Immunoglobulin genes include the kappa, lambda, alpha, gamma, delta, epsilon and mu constant region genes, as well as the myriad immunoglobulin variable domain genes.

Antibodies exist, for example as intact immunoglobulins and as antigen binding fragments produced by digestion with various peptidases. For instance, Fabs, Fvs, and single-chain Fvs (scFvs) that specifically bind to gp120 or fragments of gp120 (that include the epitope bound by the originating antibody) would be gp120-specific binding agents. A scFv protein is a fusion protein in which a light chain variable domain of an immunoglobulin and a heavy chain variable domain of an immunoglobulin are bound by a linker, while in dsFvs, the chains have been mutated to introduce a disulfide bond to stabilize the association of the chains. The term also includes genetically engineered forms such as chimeric antibodies (such as humanized murine antibodies), heteroconjugate antibodies such as bispecific antibodies). See also, *Pierce Catalog and Handbook*, 1994-1995 (Pierce Chemical Co., Rockford, Ill.); Kuby, J., *Immunology*, 3$^{rd}$ Ed., W.H. Freeman & Co., New York, 1997.

Examples of antigen-binding antibody fragments include: (1) Fab, the fragment which contains a monovalent antigen-binding fragment of an antibody molecule produced by digestion of whole antibody with the enzyme papain to yield an intact light chain and a portion of one heavy chain; (2) Fab', the fragment of an antibody molecule obtained by treating whole antibody with pepsin, followed by reduction, to yield an intact light chain and a portion of the heavy chain; two Fab' fragments are obtained per antibody molecule; (3) (Fab')$_2$, the fragment of the antibody obtained by treating whole antibody with the enzyme pepsin without subsequent reduction; (4) F(ab')$_2$, a dimer of two Fab' fragments held together by two disulfide bonds; (5) Fv, a genetically engineered fragment containing the variable domain of the light chain and the variable domain of the heavy chain expressed as two chains; and (6) single chain antibody ("SCA"), a genetically engineered molecule containing the variable domain of the light chain, the variable domain of the heavy chain, linked by a suitable polypeptide linker as a genetically fused single chain molecule. The term "antibody," as used herein, also includes antibody fragments either produced by the modification of whole antibodies or those synthesized de novo using recombinant DNA methodologies.

Typically, a naturally occurring immunoglobulin has heavy (H) chains and light (L) chains interconnected by disulfide bonds. There are two types of light chain, lambda (λ) and kappa (κ). There are five main heavy chain classes (or isotypes) which determine the functional activity of an antibody molecule: IgM, IgD, IgG, IgA and IgE.

Each heavy and light chain contains a constant region and a variable region, (the regions are also known as "domains"). In several embodiments, the heavy and the light chain variable domains combine to specifically bind the antigen. In additional embodiments, only the heavy chain variable domain is required. For example, naturally occurring camelid antibodies consisting of a heavy chain only are functional and stable in the absence of light chain (see, e.g., Hamers-Casterman et al., *Nature,* 363:446-448, 1993; Sheriff et al., *Nat. Struct. Biol.,* 3:733-736, 1996). Light and heavy chain variable domains contain a "framework" region interrupted by three hypervariable regions, also called "complementarity-determining regions" or "CDRs" (see, e.g., Kabat et al., *Sequences of Proteins of Immunological Interest*, U.S. Department of Health and Human Services, 1991). The sequences of the framework regions of different light or heavy chains are relatively conserved within a species. The framework region of an antibody, that is the combined framework regions of the constituent light and heavy chains, serves to position and align the CDRs in three-dimensional space.

The CDRs are primarily responsible for binding to an epitope of an antigen. The amino acid sequence boundaries of a given CDR can be readily determined using any of a number of well-known schemes, including those described by Kabat et al. ("Sequences of Proteins of Immunological Interest," 5th Ed. Public Health Service, National Institutes of Health, Bethesda, Md., 1991; "Kabat" numbering scheme), Al-Lazikani et al., (JMB 273,927-948, 1997; "Chothia" numbering scheme), and Lefranc et al. ("IMGT unique numbering for immunoglobulin and T cell receptor variable domains and Ig superfamily V-like domains," Dev. Comp. Immunol., 27:55-77, 2003; "IMGT" numbering scheme).

The CDRs of each chain are typically referred to as CDR1, CDR2, and CDR3 (from the N-terminus to C-terminus), and are also typically identified by the chain in which the particular CDR is located. Thus, a $V_H$ CDR3 is the CDR3 from the variable domain of the heavy chain of the antibody in which it is found, whereas a $V_L$ CDR1 is the CDR1 from the variable domain of the light chain of the antibody in which it is found. Light chain CDRs are sometimes referred to as LCDR1, LCDR2, and LCDR3. Heavy chain CDRs are sometimes referred to as LCDR1, LCDR2, and LCDR3.

References to "$V_H$" or "VH" refer to the variable domain of an immunoglobulin heavy chain, including that of an antibody fragment, such as Fv, scFv, dsFv or Fab. References to "$V_L$" or "VL" refer to the variable domain of an immunoglobulin light chain, including that of an Fv, scFv, dsFv or Fab.

A "monoclonal antibody" is an antibody produced by a single clone of B-lymphocytes or by a cell into which the light and heavy chain genes of a single antibody have been transfected. Monoclonal antibodies are produced by methods known to those of skill in the art, for instance by making hybrid antibody-forming cells from a fusion of myeloma cells with immune spleen cells. These fused cells and their progeny are termed "hybridomas." Monoclonal antibodies include humanized and fully human monoclonal antibodies. In some examples monoclonal antibodies are isolated from a subject. The amino acid sequences of such isolated monoclonal antibodies can be determined.

A "humanized" immunoglobulin is an immunoglobulin including a human framework region and one or more CDRs from a non-human (such as a mouse, rat, or synthetic) immunoglobulin. The non-human immunoglobulin providing the CDRs is termed a "donor," and the human immunoglobulin providing the framework is termed an "acceptor." In one embodiment, all the CDRs are from the donor immunoglobulin in a humanized immunoglobulin. Constant regions need not be present, but if they are, they must be substantially identical to human immunoglobulin constant regions, such as at least about 85-90%, such as about 95% or more identical. Hence, all parts of a humanized immunoglobulin, except possibly the CDRs, are substantially identical to corresponding parts of natural human immunoglobulin sequences. A "humanized antibody" is an antibody including a humanized light chain and a humanized heavy chain immunoglobulin. A humanized antibody binds to the same antigen as the donor antibody that provides the CDRs. The acceptor framework of a humanized immunoglobulin or antibody may have a limited number of substitutions by amino acids taken from the donor framework. Humanized or other monoclonal antibodies can have additional conservative amino acid substitutions, such as in the framework region, which have substantially no effect on antigen binding or other immunoglobulin functions. Humanized immunoglobulins can be constructed by means of genetic engineering (for example, see U.S. Pat. No. 5,585,089).

Antibody Scaffold: Refers to a heterologous protein that is engrafted with one or more CDRs from an antibody of interest on its surface. Transplantation of the CDRs can performed computationally in a manner that preserves its relevant structure and conformation. Mutations within the acceptor scaffold are made in order to accommodate the CDR graft.

Antibody Immunogenicity: A property of an antibody, whereby the antibody generates an immune response when administered to a subject, such as a human subject. In several embodiments, a disclosed antibody is not immunogenic or has low immunogenicity, for example, a disclosed antibody is not significantly more immunogenic compared to a standard control, or a reference antibody. Methods of determining the immunogenicity of an antibody are known to the person of ordinary skill in the art (see, e.g., Krieckaert et al., *Current Opin Rheumatol.*, 24:306-311, 2012; Stas and Lasters, *IDrugs*, 12:169-173, 2009). In one non-limiting example, immunogenicity can be determined by assaying plasma or serum from a test subject using an ELISA against the antibody of interest.

Antibody self-reactivity or autoreactivity: A property of an antibody, whereby the antibody reacts with self-epitopes, that is epitopes of proteins and/or lipids that are produced by the subject. An antibody that does not have self-reactivity does not substantially bind to epitopes or lipids present on the membrane of a cell from a subject. Methods of determining if an antibody reacts with self epitopes are known to the person of ordinary skill in the art and described herein (for example, in Examples 1 and 8). In one example, antibody self reactivity is evaluated using an anti-cardiolipin assay or an anti-nuclear antigen (ANA) assay. The anti-ANA assay can include an anti-ANA LUMINEX® assay or an ANA cell-staining assay, for example. In several embodiments, a disclosed antibody is not self-reactive (or autoreactive), or is minimally self-reactive. In one non-limiting example, a disclosed antibody is not significantly more self-reactive compared to the VRC01 antibody, for example as measured using an anti-ANA LUMINEX® assay or an ANA cell-staining assay. In another non-limiting example, a disclosed antibody noes not have self reactivity above background levels, for example, as measured using an anti-ANA LUMINEX® assay or an ANA cell-staining assay.

Antigen: A polypeptide that can stimulate the production of antibodies or a T cell response in an animal, including polypeptides that are injected or absorbed into an animal. An antigen reacts with the products of specific humoral or cellular immunity, including those induced by heterologous antigens, such as the disclosed antigens. "Epitope" or "antigenic determinant" refers to the region of an antigen to which B and/or T cells respond. In one embodiment, T cells respond to the epitope, when the epitope is presented in conjunction with an MHC molecule. Epitopes can be formed both from contiguous amino acids or noncontiguous amino acids juxtaposed by tertiary folding of a protein. Epitopes formed from contiguous amino acids are typically retained on exposure to denaturing solvents whereas epitopes formed by tertiary folding are typically lost on treatment with denaturing solvents. An epitope typically includes at least 3, and more usually, at least 5, about 9, or about 8-10 amino acids in a unique spatial conformation. Methods of determining spatial conformation of epitopes include, for example, x-ray crystallography and nuclear magnetic resonance.

Immunogenic polypeptides and immunogenic peptides are non-limiting examples of antigens. In some examples, antigens include polypeptides derived from a pathogen of interest, such as a virus. An antigen that can stimulate the production of antibodies or a T cell response in a subject to a polypeptide expressed by a virus is a viral antigen. An "HIV antigen" can stimulate the production of antibodies or a T cell response in a subject to a polypeptide expressed by HIV. In some embodiments, an HIV antigen is a polypeptide expressed by HIV, such as HIV ENV, or a fragment thereof, such as gp120.

A "target epitope" is a specific epitope on an antigen that specifically binds an antibody of interest, such as a monoclonal antibody. In some examples, a target epitope includes the amino acid residues that contact the antibody of interest, such that the target epitope can be selected by the amino acid residues determined to be in contact with the antibody of interest.

Antigenic surface: A surface of a molecule, for example a protein such as a gp120 protein or polypeptide, capable of eliciting an immune response. An antigenic surface includes the defining features of that surface, for example the three-dimensional shape and the surface charge. An antigenic surface includes both surfaces that occur on gp120 polypeptides as well as surfaces of compounds that mimic the surface of a gp120 polypeptide (mimetics). In some examples, an antigenic surface includes all or part of the surface of gp120 that binds to the CD4 receptor.

Anti-retroviral agent: An agent that specifically inhibits a retrovirus from replicating or infecting cells. Non-limiting examples of antiretroviral drugs include entry inhibitors (e.g., enfuvirtide), CCR5 receptor antagonists (e.g., aplaviroc, vicriviroc, maraviroc), reverse transcriptase inhibitors (e.g., lamivudine, zidovudine, abacavir, tenofovir, emtricitabine, efavirenz), protease inhibitors (e.g., lopivar, ritonavir, raltegravir, darunavir, atazanavir), maturation inhibitors (e.g., alpha interferon, bevirimat and vivecon).

Anti-retroviral therapy (ART): A therapeutic treatment for HIV infection involving administration of at least one anti-retroviral agents (e.g., one, two, three or four anti-retroviral agents) to an HIV infected individual during a course of treatment. Non-limiting examples of antiretroviral agents include entry inhibitors (e.g., enfuvirtide), CCR5 receptor antagonists (e.g., aplaviroc, vicriviroc, maraviroc), reverse transcriptase inhibitors (e.g., lamivudine, zidovudine, abacavir, tenofovir, emtricitabine, efavirenz), protease inhibitors (e.g., lopivar, ritonavir, raltegravir, darunavir, atazanavir), maturation inhibitors (e.g., alpha interferon, bevirimat and vivecon). One example of an ART regimen includes treatment with a combination of tenofovir, emtricitabine and efavirenz. In some examples, ART includes Highly Active Anti-Retroviral Therapy (HAART).

Atomic Coordinates or Structure coordinates: Mathematical coordinates derived from mathematical equations related to the patterns obtained on diffraction of a monochromatic beam of X-rays by the atoms (scattering centers) such as an antigen, or an antigen in complex with an antibody. In some examples that antigen can be gp120, a gp120:antibody complex, or combinations thereof in a crystal. The diffraction data are used to calculate an electron density map of the repeating unit of the crystal. The electron density maps are used to establish the positions of the individual atoms within the unit cell of the crystal. In one example, the term "structure coordinates" refers to Cartesian coordinates derived from mathematical equations related to the patterns obtained on diffraction of a monochromatic beam of X-rays, such as by the atoms of a gp120 in crystal form.

Those of ordinary skill in the art understand that a set of structure coordinates determined by X-ray crystallography is not without standard error. For the purpose of this disclosure, any set of structure coordinates that have a root mean square deviation of protein backbone atoms (N, C$\alpha$, C and 0) of less than about 1.0 Angstroms when superimposed, such as about 0.75, or about 0.5, or about 0.25 Angstroms, using backbone atoms, shall (in the absence of an explicit statement to the contrary) be considered identical.

Binding affinity: Affinity of an antibody or antigen binding fragment thereof for an antigen. In one embodiment, affinity is calculated by a modification of the Scatchard method described by Frankel et al., *Mol. Immunol.*, 16:101-106, 1979. In another embodiment, binding affinity is measured by an antigen/antibody dissociation rate. In yet another embodiment, a high binding affinity is measured by a competition radioimmunoassay. In several examples, a high binding affinity is at least about $1\times10^{-8}$ M. In other embodiments, a high binding affinity is at least about $1.0\times10^{-8}$, at least about $5.0\times10^{-8}$, at least about $1.0\times10^{-9}$, at least about $1.5\times10^{-9}$, at least about $2.0\times10^{-9}$, at least about $2.5\times10^{-9}$, or at least about $3.0\times10^{-9}$.

Bispecific antibody: A recombinant molecule composed of two different antigen binding domains that consequently bind to two different antigenic epitopes. Bispecific antibodies include chemically or genetically linked molecules of two antigen-binding domains. The antigen binding domains can be linked using a linker. The antigen binding domains can be monoclonal antibodies, antigen-binding fragments (e.g., Fab, scFv), eAds, bispecific single chain antibodies or combinations thereof. A bispecific antibody can include one or more constant domains, but does not necessarily include a constant domain. An example of a bispecific antibody is a bispecific single chain antibody including a scFv that specifically binds to gp120 joined (via a peptide linker) to a scFv that specifically binds to an antigen other than gp120. Another example is a bispecific antibody including a Fab that specifically binds to gp120 joined to a scFv that specifically binds to an antigen other than gp120.

CD4: Cluster of differentiation factor 4 polypeptide; a T-cell surface protein that mediates interaction with the MHC class II molecule. CD4 also serves as the primary receptor site for HIV on T-cells during HIV infection. CD4 is known to bind to gp120 from HIV. The known sequence of the CD4 precursor has a hydrophobic signal peptide, an extracellular region of approximately 370 amino acids, a highly hydrophobic stretch with significant identity to the membrane-spanning domain of the class II MHC beta chain, and a highly charged intracellular sequence of 40 resides (Maddon, *Cell* 42:93, 1985).

The term "CD4" includes polypeptide molecules that are derived from CD4 include fragments of CD4, generated either by chemical (for example enzymatic) digestion or genetic engineering means. Such a fragment may be one or more entire CD4 protein domains. The extracellular domain of CD4 consists of four contiguous immunoglobulin-like regions (D1, D2, D3, and D4, see Sakihama et al., *Proc. Natl. Acad. Sci.* 92:6444, 1995; U.S. Pat. No. 6,117,655), and amino acids 1 to 183 have been shown to be involved in gp120 binding. For instance, a binding molecule or binding domain derived from CD4 would include a sufficient portion of the CD4 protein to mediate specific and functional interaction between the binding fragment and a native or viral binding site of CD4. One such binding fragment includes both the D1 and D2 extracellular domains of CD4 (D1D2 is also a fragment of soluble CD4 or sCD4 which is comprised of D1 D2 D3 and D4), although smaller fragments may also provide specific and functional CD4-like binding. The gp120-binding site has been mapped to D1 of CD4.

CD4 polypeptides also include "CD4-derived molecules" which encompasses analogs (non-protein organic molecules), derivatives (chemically functionalized protein molecules obtained starting with the disclosed protein sequences) or mimetics (three-dimensionally similar chemicals) of the native CD4 structure, as well as proteins sequence variants or genetic alleles that maintain the ability to functionally bind to a target molecule.

CD4 binding site (CD4BS) antibodies: Antibodies that bind to or substantially overlap the CD4 binding surface of a gp120 polypeptide. The antibodies interfere with or prevent CD4 from binding to a gp120 polypeptide.

Chimeric antibody: An antibody which includes sequences derived from two different antibodies, such as from different species. In some examples, a chimeric antibody includes one or more CDRs and/or framework regions from one human antibody and CDRs and/or framework regions from another human antibody.

Clonal variant: Any sequence, which differs by one or more nucleotides or amino acids, in presence of V region with identical mutations compared to the germline, identical VDJ or VJ gene usage, and identical D and J length. The "germline" sequence is intended to be the sequence coding for the antibody/immunoglobulin (or of any fragment thereof) deprived of mutations, for example somatic mutations. The percentage of homology represents an indication of the mutational events which any type of heavy chain portion undergoes after contact with an antigen.

Conjugate: A complex of two molecules linked together, for example, linked together by a covalent bond. In one embodiment, an antibody is linked to an effector molecule; for example, an antibody that specifically binds to gp120 covalently linked to an effector molecule or to a toxin. The linkage can be by chemical or recombinant means. In one embodiment, the linkage is chemical, wherein a reaction between the antibody moiety and the effector molecule has produced a covalent bond formed between the two molecules to form one molecule. A peptide linker (short peptide sequence) can optionally be included between the antibody and the effector molecule. Because conjugates can be prepared from two molecules with separate functionalities, such as an antibody and an effector molecule, they are also sometimes referred to as "chimeric molecules." In one embodiment, an antibody linked to an effector molecule is further joined to a lipid or other molecule to a protein or peptide to increase its half-life in the body.

Contacting: Placement in direct physical association; includes both in solid and liquid form, which can take place either in vivo or in vitro. Contacting includes contact between one molecule and another molecule, for example the amino acid on the surface of one polypeptide, such as an antigen, that contacts another polypeptide, such as an antibody. Contacting can also include contacting a cell for example by placing an antibody in direct physical association with a cell.

Control: A reference standard. In some embodiments, the control is a negative control, such as sample obtained from a healthy patient not infected with HIV. In other embodiments, the control is a positive control, such as a tissue sample obtained from a patient diagnosed with HIV infection. In still other embodiments, the control is a historical control or standard reference value or range of values (such as a previously tested control sample, such as a group of HIV patients with known prognosis or outcome, or group of samples that represent baseline or normal values).

A difference between a test sample and a control can be an increase or conversely a decrease. The difference can be a qualitative difference or a quantitative difference, for example a statistically significant difference. In some examples, a difference is an increase or decrease, relative to a control, of at least about 5%, such as at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, or at least about 500%.

Cross complementation: Formation of an antibody including a heavy and light chain variable domains using a heavy chain variable domain of an antibody that specifically binds an epitope of an antigen of interest from first antibody and a light chain variable domain of an antibody that specifically binds the same epitope from a second antibody, wherein the antibody that is formed from the heavy chain variable domain and the light chain variable domain retains its ability to bind the epitope and wherein the first and the second antibodies are different antibodies. Thus, in cross complementation, the light chain variable domains and the heavy chain variable domains that form an antibody are from different sources, but the chimeric antibody that is formed still binds the epitope. In one embodiment, the antigen is gp120. In one embodiment an antibody that specifically binds to gp120 includes a heavy chain cross-complemented with a light chain, wherein the heavy chain includes the heavy chain variable domain of VRC07 (SEQ ID NO: 2) and the light chain includes the light chain variable domain of VRC01 (SEQ ID NO: 9).

Cytotoxicity: The toxicity of a molecule, such as an immunotoxin, to the cells intended to be targeted, as opposed to the cells of the rest of an organism. In one embodiment, in contrast, the term "toxicity" refers to toxicity of an immunotoxin to cells other than those that are the cells intended to be targeted by the targeting moiety of the immunotoxin, and the term "animal toxicity" refers to toxicity of the immunotoxin to an animal by toxicity of the immunotoxin to cells other than those intended to be targeted by the immunotoxin.

Detectable marker: A detectable molecule (also known as a label) that is conjugated directly or indirectly to a second molecule, such as an antibody, to facilitate detection of the second molecule. For example, the detectable marker can be capable of detection by ELISA, spectrophotometry, flow cytometry, microscopy or diagnostic imaging techniques (such as CT scans, MRIs, ultrasound, fiberoptic examination, and laparoscopic examination). Specific, non-limiting examples of detectable markers include fluorophores, fluorescent proteins, chemiluminescent agents, enzymatic linkages, radioactive isotopes and heavy metals or compounds (for example super paramagnetic iron oxide nanocrystals for detection by MRI). In one example, a "labeled antibody" refers to incorporation of another molecule in the antibody. For example, the label is a detectable marker, such as the incorporation of a radiolabeled amino acid or attachment to a polypeptide of biotinyl moieties that can be detected by marked avidin (for example, streptavidin containing a fluorescent marker or enzymatic activity that can be detected by optical or colorimetric methods). Various methods of labeling polypeptides and glycoproteins are known in the art and may be used. Examples of labels for polypeptides include, but are not limited to, the following: radioisotopes or radionuclides (such as $^{35}S$ or $^{131}I$) fluorescent labels (such as fluorescein isothiocyanate (FITC), rhodamine, lanthanide phosphors), enzymatic labels (such as horseradish peroxidase, beta-galactosidase, luciferase, alkaline phosphatase), chemiluminescent markers, biotinyl groups, predetermined polypeptide epitopes recognized by a secondary reporter (such as a leucine zipper pair sequences, binding sites for secondary antibodies, metal binding domains, epitope tags), or magnetic agents, such as gadolinium chelates. In some embodiments, labels are attached by spacer arms of various lengths to reduce potential steric hindrance. Methods for using detectable markers and guidance in the choice of detectable markers appropriate for various purposes are discussed for example in Sambrook et al. (Molecular Cloning: A Laboratory Manual, Cold Spring Harbor, N.Y., 1989) and Ausubel et al. (In Current Protocols in Molecular Biology, John Wiley & Sons, New York, 1998).

Detecting: To identify the existence, presence, or fact of something. General methods of detecting are known to the skilled artisan and may be supplemented with the protocols and reagents disclosed herein. For example, included herein are methods of detecting a cell that expresses gp120 in a subject.

DNA sequencing: The process of determining the nucleotide order of a given DNA molecule. The general characteristics of "deep sequencing" are that genetic material is amplified, such as by polymerase chain reaction, and then the amplified products are ligated to a solid surface. The sequence of the amplified target genetic material is then performed in parallel and the sequence information is captured by a computer. Generally, the sequencing can be performed using automated Sanger sequencing (AB13730x1 genome analyzer), pyrosequencing on a solid support (454 sequencing, Roche), sequencing-by-synthesis with reversible terminations (ILLUMINA® Genome Analyzer), sequencing-by-ligation (ABI SOLiD®) or sequencing-by-synthesis with virtual terminators (HELISCOPE®).

In some embodiments, DNA sequencing is performed using a chain termination method developed by Frederick Sanger, and thus termed "Sanger based sequencing" or "SBS." This technique uses sequence-specific termination of a DNA synthesis reaction using modified nucleotide substrates. Extension is initiated at a specific site on the template DNA by using a short oligonucleotide primer complementary to the template at that region. The oligonucleotide primer is extended using DNA polymerase in the presence of the four deoxynucleotide bases (DNA building blocks), along with a low concentration of a chain terminating nucleotide (most commonly a di-deoxynucleotide). Limited incorporation of the chain terminating nucleotide by the DNA polymerase results in a series of related DNA fragments that are terminated only at positions where that particular nucleotide is present. The fragments are then size-separated by electrophoresis a polyacrylamide gel, or in a narrow glass tube (capillary) filled with a viscous polymer. An alternative to using a labeled primer is to use labeled terminators instead; this method is commonly called "dye terminator sequencing."

"Pyrosequencing" is an array based method, which has been commercialized by 454 Life Sciences (Branford, Conn.). In some embodiments of the array-based methods, single-stranded DNA is annealed to beads and amplified via EmPCR®. These DNA-bound beads are then placed into wells on a fiber-optic chip along with enzymes that produce light in the presence of ATP. When free nucleotides are washed over this chip, light is produced as the PCR amplification occurs and ATP is generated when nucleotides join with their complementary base pairs. Addition of one (or more) nucleotide(s) results in a reaction that generates a light signal that is recorded, such as by the charge coupled device (CCD) camera, within the instrument. The signal strength is proportional to the number of nucleotides, for example, homopolymer stretches, incorporated in a single nucleotide flow.

Effector molecule: The portion of a chimeric molecule that is intended to have a desired effect on a cell or protein to which the chimeric molecule is targeted. Effector molecule is also known as an effector moiety, therapeutic agent, or diagnostic agent, or similar terms.

Epitope: An antigenic determinant. These are particular chemical groups or peptide sequences on a molecule that are antigenic, i.e. that elicit a specific immune response. An antibody specifically binds a particular antigenic epitope on a polypeptide. In some examples a disclosed antibody specifically binds to an epitope on the surface of gp120 from HIV.

Epitope Scaffold: Refers to a heterologous protein that is engrafted with a foreign epitope of interest on its surface. Transplantation of the epitope is performed computationally in a manner that preserves its relevant structure and conformation. Mutations within the acceptor scaffold are made in order to accommodate the epitope graft. The graft can be modified to represent the sequences of different clades and strains.

Fc polypeptide: The polypeptide including the constant region of an antibody excluding the first constant region immunoglobulin domain. Fc region generally refers to the last two constant region immunoglobulin domains of IgA, IgD, and IgG, and the last three constant region immunoglobulin domains of IgE and IgM. An Fc region may also include part or all of the flexible hinge N-terminal to these domains. For IgA and IgM, an Fc region may or may not include the tailpiece, and may or may not be bound by the J chain. For IgG, the Fc region includes immunoglobulin domains Cgamma2 and Cgamma3 (Cγ2 and Cγ3) and the lower part of the hinge between Cgamma1 (Cγ1) and Cγ2. Although the boundaries of the Fc region may vary, the human IgG heavy chain Fc region is usually defined to include residues C226 or P230 to its carboxyl-terminus, wherein the numbering is according to the EU index as in Kabat. For IgA, the Fc region includes immunoglobulin domains Calpha2 and Calpha3 (Cα2 and Cα3) and the lower part of the hinge between Calpha1 (Cα1) and Cα2. Encompassed within the definition of the Fc region are functionally equivalent analogs and variants of the Fc region. A functionally equivalent analog of the Fc region may be a variant Fc region, including one or more amino acid modifications relative to the wild-type or naturally existing Fc region. Variant Fc regions will possess at least 50% homology with a naturally existing Fc region, such as about 80%, and about 90%, or at least about 95% homology. Functionally equivalent analogs of the Fc region may include one or more amino acid residues added to or deleted from the N- or C-termini of the protein, such as no more than 30 or no more than 10 additions and/or deletions. Functionally equivalent analogs of the Fc region include Fc regions operably linked to a fusion partner. Functionally equivalent analogs of the Fc region must include the majority of all of the Ig domains that compose Fc region as defined above; for example IgG and IgA Fc regions as defined herein must include the majority of the sequence encoding $CH_2$ and the majority of the sequence encoding $CH_3$. Thus, the $CH_2$ domain on its own, or the $CH_3$ domain on its own, are not considered Fc region. The Fc region may refer to this region in isolation, or this region in the context of an Fc fusion polypeptide (immunoadhesin, see below).

Framework Region: Amino acid sequences interposed between CDRs. Includes variable light and variable heavy framework regions. The framework regions serve to hold the CDRs in an appropriate orientation for antigen binding.

gp120: An envelope protein from Human Immunodeficiency Virus (HIV). This envelope protein is initially synthesized as a longer precursor protein of 845-870 amino acids in size, designated gp160. gp160 is cleaved by a cellular protease into gp120 and gp41. gp120 contains most of the external, surface-exposed, domains of the HIV envelope glycoprotein complex, and it is gp120 which binds both to cellular CD4 receptors and to cellular chemokine receptors (such as CCR5).

The mature gp120 wildtype polypeptides have about 500 amino acids in the primary sequence. gp120 is heavily N-glycosylated giving rise to an apparent molecular weight of 120 kD. The polypeptide is comprised of five conserved regions (C1-C5) and five regions of high variability (V1-V5). Exemplary sequence of wt gp120 polypeptides are shown on GENBANK®, for example accession numbers AAB05604 and AAD12142 (as available on Oct. 16, 2009), incorporated by reference herein. It is understood that there are numerous variation in the sequence of gp120 from what is given in GENBANK®, for example accession numbers AAB05604 and AAD12142, and that these variants are skill recognized in the art as gp120.

The gp120 core has a molecular structure, which includes two domains: an "inner" domain (which faces gp41) and an "outer" domain (which is mostly exposed on the surface of the oligomeric envelope glycoprotein complex). The two gp120 domains are separated by a "bridging sheet" that is not part of either domain. The gp120 core includes 25 beta strands, 5 alpha helices, and 10 defined loop segments.

The third variable domain referred to herein as the V3 loop is a loop of about 35 amino acids critical for the binding of the co-receptor and determination of which of the co-receptors will bind. In certain examples the V3 loop includes residues 296-331.

HIV Envelope protein (Env): The HIV envelope protein is initially synthesized as a longer precursor protein of 845-870 amino acids in size, designated gp160. gp160 forms a homotrimer and undergoes glycosylation within the Golgi apparatus. In vivo, it is then cleaved by a cellular protease into gp120 and gp41. gp120 contains most of the external, surface-exposed, domains of the HIV envelope glycoprotein complex, and it is gp120 which binds both to cellular CD4 receptors and to cellular chemokine receptors (such as CCR5). gp41 contains a transmembrane domain and remains in a trimeric configuration; it interacts with gp120 in a non-covalent manner.

Host cells: Cells in which a vector can be propagated and its DNA expressed, for example a disclosed antibody can be expressed in a host cell. The cell may be prokaryotic or eukaryotic. The term also includes any progeny of the subject host cell. It is understood that all progeny may not be identical to the parental cell since there may be mutations that occur during replication. However, such progeny are included when the term "host cell" is used.

Human Immunodeficiency Virus (HIV): A retrovirus that causes immunosuppression in humans (HIV disease), and leads to a disease complex known as the acquired immunodeficiency syndrome (AIDS). "HIV disease" refers to a well-recognized constellation of signs and symptoms (including the development of opportunistic infections) in persons who are infected by an HIV virus, as determined by antibody or western blot studies. Laboratory findings associated with this disease include a progressive decline in T cells. HIV includes HIV type 1 (HIV-1) and HIV type 2 (HIV-2). Related viruses that are used as animal models include simian immunodeficiency virus (SIV), and feline immunodeficiency virus (FIV). Treatment of HIV-1 with HAART has been effective in reducing the viral burden and ameliorating the effects of HIV-1 infection in infected individuals.

HXB2 numbering system: A reference numbering system for HIV protein and nucleic acid sequences, using HIV-1 HXB2 strain sequences as a reference for all other HIV strain sequences. The person of ordinary skill in the art is familiar with the HXB2 numbering system, and this system is set forth in "Numbering Positions in HIV Relative to HXB2CG," Bette Korber et al., Human Retroviruses and AIDS 1998: A Compilation and Analysis of Nucleic Acid and Amino Acid Sequences. Korber B, Kuiken C L, Foley B, Hahn B, McCutchan F, Mellors J W, and Sodroski J, Eds. Theoretical Biology and Biophysics Group, Los Alamos National Laboratory, Los Alamos, N. Mex., which is incorporated by reference herein in its entirety. HXB2 is also known as: HXBc2, for HXB clone 2; HXB2R, in the Los Alamos HIV database, with the R for revised, as it was slightly revised relative to the original HXB2 sequence; and HXB2CG in GENBANK™, for HXB2 complete genome. The numbering used in gp120 polypeptides disclosed herein is relative to the HXB2 numbering scheme.

IgA: A polypeptide belonging to the class of antibodies that are substantially encoded by a recognized immunoglobulin alpha gene. In humans, this class or isotype includes $IgA_1$ and $IgA_2$. IgA antibodies can exist as monomers, polymers (referred to as pIgA) of predominantly dimeric form, and secretory IgA. The constant chain of wild-type IgA contains an 18-amino-acid extension at its C-terminus called the tail piece (tp). Polymeric IgA is secreted by plasma cells with a 15-kDa peptide called the J chain linking two monomers of IgA through the conserved cysteine residue in the tail piece.

IgG: A polypeptide belonging to the class or isotype of antibodies that are substantially encoded by a recognized immunoglobulin gamma gene. In humans, this class includes $IgG_1$, $IgG_2$, $IgG_3$, and $IgG_4$. In mice, this class includes $IgG_1$, $IgG_{2a}$, $IgG_{2b}$, $IgG_3$.

Immune complex: The binding of antibody to a soluble antigen forms an immune complex. The formation of an immune complex can be detected through conventional methods known to the skilled artisan, for instance immunohistochemistry, immunoprecipitation, flow cytometry, immunofluorescence microscopy, ELISA, immunoblotting (for example, Western blot), magnetic resonance imaging, CT scans, X-ray and affinity chromatography. Immunological binding properties of selected antibodies may be quantified using methods well known in the art.

Immunoadhesin: A molecular fusion of a protein with the Fc region of an immunoglobulin, wherein the immunoglobulin retains specific properties, such as Fc receptor binding and increased half-life. An Fc fusion combines the Fc region of an immunoglobulin with a fusion partner, which in general can be any protein, polypeptide, peptide, or small molecule. In one example, and immunoadhesin includes the hinge, $CH_2$, and $CH_3$ domains of the immunoglobulin gamma 1 heavy chain constant region. In another example, the immunoadhesin includes the $CH_2$, and $CH_3$ domains of an IgG.

Immunogen: A compound, composition, or substance (for example, a protein or a portion thereof) that is capable of inducing an immune response in a mammal, such as a mammal infected or at risk of infection with a pathogen. Administration of an immunogen can lead to protective immunity and/or proactive immunity against a pathogen of interest. In some examples, an immunogen is an HIV antigen. Examples of immunogens include, but are not limited to, peptides, lipids, polysaccharides, combinations thereof, and nucleic acids containing antigenic determinants, such as those recognized by an immune cell. In some examples, immunogens include peptides derived from a pathogen of interest. Exemplary pathogens include bacteria, fungi, viruses and parasites. In specific examples, an immunogen is derived from HIV, such as a gp120 polypeptide derived from HIV or antigenic fragment thereof.

Immunological Probe: A molecule that can be used for selection of antibodies from sera which are directed against a specific epitope, including from human patient sera. The epitope scaffolds, along with related point mutants, can be used as immunological probes in both positive and negative selection of antibodies against the epitope graft. In some examples immunological probes are engineered variants of gp120.

Immunologically reactive conditions: Includes reference to conditions which allow an antibody raised against a particular epitope to bind to that epitope to a detectably greater degree than, and/or to the substantial exclusion of, binding to substantially all other epitopes. Immunologically reactive conditions are dependent upon the format of the antibody binding reaction and typically are those utilized in immunoassay protocols or those conditions encountered in vivo. See Harlow & Lane, supra, for a description of immunoassay formats and conditions. The immunologically reactive conditions employed in the methods are "physiological conditions" which include reference to conditions (e.g., temperature, osmolarity, pH) that are typical inside a living mammal or a mammalian cell. While it is recognized that some organs are subject to extreme conditions, the intra-organismal and intracellular environment normally lies around pH 7 (e.g., from pH 6.0 to pH 8.0, more typically pH 6.5 to 7.5), contains water as the predominant solvent, and exists at a temperature above 0° C. and below 50° C. Osmolarity is within the range that is supportive of cell viability and proliferation.

Inhibiting or treating a disease: Inhibiting the full development of a disease or condition, for example, in a subject who is at risk for a disease such as acquired immunodeficiency syndrome (AIDS). "Treatment" refers to a therapeutic intervention that ameliorates a sign or symptom of a disease or pathological condition after it has begun to develop. The term "ameliorating," with reference to a disease or pathological condition, refers to any observable beneficial effect of the treatment. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters well known in the art that are specific to the particular disease. A "prophylactic" treatment is a treatment administered to a subject who does not exhibit signs of a disease or exhibits only early signs for the purpose of decreasing the risk of developing pathology.

Isolated: An "isolated" biological component (such as a cell, for example a B cell, a nucleic acid, peptide, protein or antibody) has been substantially separated, produced apart from, or purified away from other biological components in the cell of the organism in which the component naturally occurs, such as, other chromosomal and extrachromosomal DNA and RNA, and proteins. Nucleic acids, peptides and proteins which have been "isolated" thus include nucleic acids and proteins purified by standard purification methods. The term also embraces nucleic acids, peptides, and proteins prepared by recombinant expression in a host cell as well as chemically synthesized nucleic acids. In some examples an antibody, such as an antibody specific for gp120 can be isolated, for example isolated from a subject infected with HIV.

$K_d$: The dissociation constant for a given interaction, such as a polypeptide ligand interaction or an antibody antigen interaction. For example, for the bimolecular interaction of an antibody (such as VRC07 or variant thereof as disclosed herein) and an antigen (such as gp120) it is the concentration of the individual components of the bimolecular interaction divided by the concentration of the complex.

Label: A detectable compound or composition that is conjugated directly or indirectly to another molecule, such as an antibody or a protein, to facilitate detection of that molecule. Specific, non-limiting examples of labels include fluorescent tags, enzymatic linkages, and radioactive isotopes. In some examples, a disclosed antibody is labeled.

Linker: A bi-functional molecule that can be used to link two molecules into one contiguous molecule, for example, to link an effector molecule to an antibody. In some embodiments, a conjugate includes a linker between the effector molecule or detectable marker and an antibody. In some embodiments, the linker is cleavable under intracellular conditions, such that cleavage of the linker releases the effector molecule or detectable marker from the antibody in the intracellular environment. In yet other embodiments, the linker is not cleavable and the effector molecule or detectable marker can be released, for example, by antibody degradation. In some cases, a linker is a peptide within an antibody binding fragment (such as an Fv fragment) which serves to indirectly bond the variable heavy chain to the variable light chain.

In several embodiments, the terms "conjugating," "joining," "bonding" or "linking" refer to making two polypeptides into one contiguous polypeptide molecule, to covalently attaching a radionuclide or other molecule to a polypeptide, such as an antibody that specifically binds gp120, or an antibody binding fragment thereof. In the specific context, the terms include reference to joining a ligand, such as an antibody moiety, to an effector molecule. The linkage can be either by chemical or recombinant means. "Chemical means" refers to a reaction between the antibody moiety and the effector molecule such that there is a covalent bond formed between the two molecules to form one molecule.

Neutralizing antibody: An antibody which reduces the infectious titer of an infectious agent by binding to a specific antigen on the infectious agent. In some examples the infectious agent is a virus. In some examples, an antibody that is specific for gp120 neutralizes the infectious titer of HIV. A "broadly neutralizing antibody" is an antibody that binds to and inhibits the function of related antigens, such as antigens that share at least 85%, 90%, 95%, 96%, 97%, 98% or 99% identity with antigenic surface of the antigen. With regard to an antigen from a pathogen, such as a virus, the antibody can bind to and inhibit the function of an antigen from more than one class and/or subclass of the pathogen. For example, with regard to a human immunodeficiency virus, the antibody can bind to and inhibit the function of an antigen, such as gp120 from more than one Glade. In one embodiment, broadly neutralizing antibodies to HIV are distinct from other antibodies to HIV in that they neutralize a high percentage of the many types of HIV in circulation.

Nucleic acid: A polymer composed of nucleotide units (ribonucleotides, deoxyribonucleotides, related naturally occurring structural variants, and synthetic non-naturally occurring analogs thereof) linked via phosphodiester bonds, related naturally occurring structural variants, and synthetic non-naturally occurring analogs thereof. Thus, the term includes nucleotide polymers in which the nucleotides and the linkages between them include non-naturally occurring synthetic analogs, such as, for example and without limitation, phosphorothioates, phosphoramidates, methyl phosphonates, chiral-methyl phosphonates, 2-O-methyl ribonucleotides, peptide-nucleic acids (PNAs), and the like. Such polynucleotides can be synthesized, for example, using an automated DNA synthesizer. The term "oligonucleotide" typically refers to short polynucleotides, generally no greater than about 50 nucleotides. It will be understood that when a nucleotide sequence is represented by a DNA sequence (i.e., A, T, G, C), this also includes an RNA sequence (i.e., A, U, G, C) in which "U" replaces "T."

Conventional notation is used herein to describe nucleotide sequences: the left-hand end of a single-stranded nucleotide sequence is the 5'-end; the left-hand direction of a double-stranded nucleotide sequence is referred to as the 5'-direction. The direction of 5' to 3' addition of nucleotides to nascent RNA transcripts is referred to as the transcription direction. The DNA strand having the same sequence as an mRNA is referred to as the "coding strand;" sequences on the DNA strand having the same sequence as an mRNA transcribed from that DNA and which are located 5' to the 5'-end of the RNA transcript are referred to as "upstream sequences;" sequences on the DNA strand having the same sequence as the RNA and which are 3' to the 3' end of the coding RNA transcript are referred to as "downstream sequences."

"cDNA" refers to a DNA that is complementary or identical to an mRNA, in either single stranded or double stranded form.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA produced by that gene produces the protein in a cell or other biological system. Both the coding strand, the nucleotide sequence of which is identical to the mRNA sequence and is usually provided in sequence listings, and non-coding strand, used as the template for transcription, of a gene or cDNA can be referred to as encoding the protein or other product of that gene or cDNA. Unless otherwise specified, a "nucleotide sequence encoding an amino acid sequence" includes all nucleotide sequences that are degenerate versions of each other and that encode the same amino acid sequence. Nucleotide sequences that encode proteins and RNA may include introns.

"Recombinant nucleic acid" refers to a nucleic acid having nucleotide sequences that are not naturally joined together. his includes nucleic acid vectors including an amplified or assembled nucleic acid which can be used to transform a suitable host cell. A host cell that includes the recombinant nucleic acid is referred to as a "recombinant host cell." The gene is then expressed in the recombinant host cell to produce, e.g., a "recombinant polypeptide." A recombinant nucleic acid may serve a non-coding function (e.g., promoter, origin of replication, ribosome-binding site, etc.) as well.

A first sequence is an "antisense" with respect to a second sequence if a polynucleotide whose sequence is the first sequence specifically hybridizes with a polynucleotide whose sequence is the second sequence.

Terms used to describe sequence relationships between two or more nucleotide sequences or amino acid sequences include "reference sequence," "selected from," "comparison window," "identical," "percentage of sequence identity," "substantially identical," "complementary," and "substantially complementary."

For sequence comparison of nucleic acid sequences, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters are used. Methods of alignment of sequences for comparison are well known in the art. Optimal alignment of sequences for comparison can be conducted, e.g., by the local homology algorithm of Smith & Waterman, *Adv. Appl. Math.* 2:482, 1981, by the homology alignment algorithm of Needleman & Wunsch, *J. Mol. Biol.* 48:443, 1970, by the search for similarity method of Pearson & Lipman, *Proc. Nat'l. Acad. Sci. USA* 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds 1995 supplement)).

One example of a useful algorithm is PILEUP. PILEUP uses a simplification of the progressive alignment method of Feng & Doolittle, *J. Mol. Evol.* 35:351-360, 1987. The method used is similar to the method described by Higgins & Sharp, *CABIOS* 5:151-153, 1989. Using PILEUP, a reference sequence is compared to other test sequences to determine the percent sequence identity relationship using the following parameters: default gap weight (3.00), default gap length weight (0.10), and weighted end gaps. PILEUP can be obtained from the GCG sequence analysis software package, e.g., version 7.0 (Devereaux et al., *Nuc. Acids Res.* 12:387-395, 1984.

Another example of algorithms that are suitable for determining percent sequence identity and sequence similarity are the BLAST and the BLAST 2.0 algorithm, which are described in Altschul et al., *J. Mol. Biol.* 215:403-410, 1990 and Altschul et al., *Nucleic Acids Res.* 25:3389-3402, 1977. Software for performing BLAST analyses is publicly available through the National Center for Biotechnology Information (ncbi.nlm.nih.gov). The BLASTN program (for nucleotide sequences) uses as defaults a word length (W) of 11, alignments (B) of 50, expectation (E) of 10, M=5, N=−4, and a comparison of both strands. The BLASTP program (for amino acid sequences) uses as defaults a word length (W) of 3, and expectation (E) of 10, and the BLOSUM62 scoring matrix (see Henikoff & Henikoff, *Proc. Natl. Acad. Sci. USA* 89:10915, 1989). An oligonucleotide is a linear polynucleotide sequence of up to about 100 nucleotide bases in length.

A polynucleotide or nucleic acid sequence refers to a polymeric form of nucleotide at least 10 bases in length. A recombinant polynucleotide includes a polynucleotide that is not immediately contiguous with both of the coding sequences with which it is immediately contiguous (one on the 5' end and one on the 3' end) in the naturally occurring genome of the organism from which it is derived. The term therefore includes, for example, a recombinant DNA which is incorporated into a vector; into an autonomously replicating plasmid or virus; or into the genomic DNA of a prokaryote or eukaryote, or which exists as a separate molecule (e.g., a cDNA) independent of other sequences. The nucleotides can be ribonucleotides, deoxyribonucleotides, or modified forms of either nucleotide. The term includes single- and double-stranded forms of DNA. A gp120 polynucleotide is a nucleic acid encoding a gp120 polypeptide.

Operably linked: A first nucleic acid sequence is operably linked with a second nucleic acid sequence when the first nucleic acid sequence is placed in a functional relationship with the second nucleic acid sequence. For instance, a promoter, such as the CMV promoter, is operably linked to a coding sequence if the promoter affects the transcription or expression of the coding sequence. Generally, operably linked DNA sequences are contiguous and, where necessary to join two protein-coding regions, in the same reading frame.

Pharmaceutically acceptable carriers: The pharmaceutically acceptable carriers of use are conventional. *Remington's Pharmaceutical Sciences*, by E. W. Martin, Mack Publishing Co., Easton, Pa., 19th Edition, 1995, describes compositions and formulations suitable for pharmaceutical delivery of the disclosed antibodies.

In general, the nature of the carrier will depend on the particular mode of administration being employed. For instance, parenteral formulations usually include injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Pharmaceutical agent: A chemical compound or composition capable of inducing a desired therapeutic or prophylactic effect when properly administered to a subject or a cell. In some examples a pharmaceutical agent includes one or more of the disclosed antibodies.

Polypeptide: Any chain of amino acids, regardless of length or post-translational modification (e.g., glycosylation or phosphorylation). In one embodiment, the polypeptide is gp120 polypeptide. In one embodiment, the polypeptide is a disclosed antibody or a fragment thereof. A "residue" refers to an amino acid or amino acid mimetic incorporated in a polypeptide by an amide bond or amide bond mimetic. A polypeptide has an amino terminal (N-terminal) end and a carboxy-terminal end.

Promoter: A promoter is an array of nucleic acid control sequences that directs transcription of a nucleic acid. A promoter includes necessary nucleic acid sequences near the start site of transcription, for example, in the case of a polymerase II type promoter, a TATA element. A promoter also optionally includes distal enhancer or repressor elements which can be located as much as several thousand base pairs from the start site of transcription. Both constitutive and inducible promoters are included (see for example, Bitter et al., *Methods in Enzymology* 153:516-544, 1987).

Specific, non-limiting examples of promoters include promoters derived from the genome of mammalian cells (such as the metallothionein promoter) or from mammalian viruses (such as the retrovirus long terminal repeat; the adenovirus late promoter; the vaccinia virus 7.5K promoter) may be used. Promoters produced by recombinant DNA or synthetic techniques may also be used. A polynucleotide can be inserted into an expression vector that contains a promoter sequence which facilitates the efficient transcription of the inserted genetic sequence of the host. The expression vector typically contains an origin of replication, a promoter, as well as specific nucleic acid sequences that allow phenotypic selection of the transformed cells.

Purified: The term purified does not require absolute purity; rather, it is intended as a relative term. Thus, for example, a purified peptide preparation is one in which the peptide or protein (such as an antibody) is more enriched than the peptide or protein is in its natural environment within a cell. In one embodiment, a preparation is purified such that the protein or peptide represents at least 50% of the total peptide or protein content of the preparation.

Recombinant: A recombinant nucleic acid is one that has a sequence that is not naturally occurring or has a sequence that is made by an artificial combination of two otherwise separated segments of sequence. This artificial combination is often accomplished by chemical synthesis or, more commonly, by the artificial manipulation of isolated segments of nucleic acids, e.g., by genetic engineering techniques.

Sequence identity: The similarity between amino acid sequences is expressed in terms of the similarity between the sequences, otherwise referred to as sequence identity. Sequence identity is frequently measured in terms of percentage identity (or similarity or homology); the higher the percentage, the more similar the two sequences are. Homologs or variants of a polypeptide will possess a relatively high degree of sequence identity when aligned using standard methods.

Methods of alignment of sequences for comparison are well known in the art. Various programs and alignment algorithms are described in: Smith and Waterman, *Adv. Appl. Math.* 2:482, 1981; Needleman and Wunsch, *J. Mol. Biol.* 48:443, 1970; Pearson and Lipman, *Proc. Natl. Acad. Sci. U.S.A.* 85:2444, 1988; Higgins and Sharp, *Gene* 73:237, 1988; Higgins and Sharp, *CABIOS* 5:151, 1989; Corpet et al., *Nucleic Acids Research* 16:10881, 1988; and Pearson and Lipman, *Proc. Natl. Acad. Sci. U.S.A.* 85:2444, 1988. Altschul et al., *Nature Genet.* 6:119, 1994, presents a detailed consideration of sequence alignment methods and homology calculations.

The NCBI Basic Local Alignment Search Tool (BLAST) (Altschul et al., *J. Mol. Biol.* 215:403, 1990) is available from several sources, including the National Center for Biotechnology Information (NCBI, Bethesda, Md.) and on the internet, for use in connection with the sequence analysis programs blastp, blastn, blastx, tblastn and tblastx. A description of how to determine sequence identity using this program is available on the NCBI website on the internet.

Homologs and variants of a $V_L$ or a $V_H$ of an antibody that specifically binds a polypeptide are typically characterized by possession of at least about 75%, for example at least about 80%, 85%, 90%, 91%, 92%, 93%, 94%, 95%, 96%, 97%, 98% or 99% sequence identity counted over the full length alignment with the amino acid sequence of interest. Proteins with even greater similarity to the reference sequences will show increasing percentage identities when assessed by this method, such as at least 80%, at least 85%, at least 90%, at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet. One of skill in the art will appreciate that these sequence identity ranges are provided for guidance only; it is entirely possible that strongly significant homologs could be obtained that fall outside of the ranges provided.

Specifically bind: When referring to an antibody, refers to a binding reaction which determines the presence of a target protein, peptide, or polysaccharide in the presence of a heterogeneous population of proteins and other biologics. Thus, under designated conditions, an antibody binds preferentially to a particular target protein, peptide or polysaccharide (such as an antigen present on the surface of a pathogen, for example gp120) and does not bind in a significant amount to other proteins or polysaccharides present in the sample or subject. Specific binding can be determined by methods known in the art. With reference to an antibody antigen complex, specific binding of the antigen and antibody has a $K_d$ of less than about $10^{-6}$ Molar, such as less than about $10^{-6}$ Molar, $10^{-7}$ Molar, $10^{-8}$ Molar, $10^{-9}$, or even less than about $10^{-10}$ Molar.

T Cell: A white blood cell critical to the immune response. T cells include, but are not limited to, $CD4^+$ T cells and $CD8^+$ T cells. A $CD4^+$ T lymphocyte is an immune cell that carries a marker on its surface known as "cluster of differentiation 4" (CD4). These cells, also known as helper T cells, help orchestrate the immune response, including antibody responses as well as killer T cell responses. $CD8^+$ T cells carry the "cluster of differentiation 8" (CD8) marker. In one embodiment, a CD8 T cells is a cytotoxic T lymphocytes. In another embodiment, a CD8 cell is a suppressor T cell.

Therapeutic agent: Used in a generic sense, it includes treating agents, prophylactic agents, and replacement agents.

A therapeutic agent is used to ameliorate a specific set of conditions in a subject with a disease or a disorder.

Therapeutically effective amount: A quantity of a specific substance, such as a disclosed antibody, sufficient to achieve a desired effect in a subject being treated. For instance, this can be the amount necessary to inhibit HIV replication or treat HIV infection. In several embodiments, a therapeutically effective amount is the amount necessary to reduce a sign or symptom of HIV infection, and/or to decrease viral titer in a subject. When administered to a subject, a dosage will generally be used that will achieve target tissue concentrations that has been shown to achieve a desired in vitro effect.

Toxin: An effector molecule that induces cytotoxicity when it contacts a cell. Specific, non-limiting examples of toxins include, but are not limited to, abrin, ricin, auristatins (such as monomethyl auristatin E (MMAE; see for example, Francisco et al., Blood, 102: 1458-1465, 2003)) and monomethyl auristatin F (MMAF; see, for example, Doronina et al., BioConjugate Chem., 17: 114-124, 2006), maytansinoids (such as DM1; see, for example, Phillips et al., Cancer Res., 68:9280-9290, 2008), *Pseudomonas* exotoxin (PE, such as PE35, PE37, PE38, and PE40), diphtheria toxin (DT), botulinum toxin, saporin, restrictocin or gelonin, or modified toxins thereof, or other toxic agents that directly or indirectly inhibit cell growth or kill cells. For example, PE and DT are highly toxic compounds that typically bring about death through liver toxicity. PE and DT, however, can be modified into a form for use as an immunotoxin by removing the native targeting component of the toxin (such as the domain Ia of PE and the B chain of DT) and replacing it with a different targeting moiety, such as an antibody.

Under conditions sufficient for: A phrase that is used to describe any environment that permits a desired activity. In one example the desired activity is formation of an immune complex. In particular examples the desired activity is treatment of HIV infection.

Vector: A nucleic acid molecule as introduced into a host cell, thereby producing a transformed host cell. A vector may include nucleic acid sequences that permit it to replicate in a host cell, such as an origin of replication. A vector may also include one or more selectable marker genes and other genetic elements known in the art.

Virus: Microscopic infectious organism that reproduces inside living cells. A virus consists essentially of a core of a single nucleic acid surrounded by a protein coat, and has the ability to replicate only inside a living cell. "Viral replication" is the production of additional virus by the occurrence of at least one viral life cycle. A virus may subvert the host cells' normal functions, causing the cell to behave in a manner determined by the virus. For example, a viral infection may result in a cell producing a cytokine, or responding to a cytokine, when the uninfected cell does not normally do so.

"Retroviruses" are RNA viruses wherein the viral genome is RNA. When a host cell is infected with a retrovirus, the genomic RNA is reverse transcribed into a DNA intermediate which is integrated very efficiently into the chromosomal DNA of infected cells. The integrated DNA intermediate is referred to as a provirus. The term "lentivirus" is used in its conventional sense to describe a genus of viruses containing reverse transcriptase. The lentiviruses include the "immunodeficiency viruses" which include human immunodeficiency virus (HIV) type 1 and type 2 (HIV-I and HIV-II), simian immunodeficiency virus (SIV), and feline immunodeficiency virus (FIV).

VRC01: A monoclonal antibody that specifically binds to gp120 and is neutralizes a broad range of HIV viruses, wherein the sequences of the heavy and light chain variable domains of VRC01 are set forth herein as SEQ ID NO: 5 and SEQ ID NO: 9, respectively. See also, Wu et al., Science, 329(5993):856-861, 2010, and PCT publication WO2012/154312, incorporated by reference herein in its entirety.

VRC01-like antibody, heavy chain or light chain: A VRC01-like antibody or a heavy chain or light chain that can complement with a corresponding heavy chain or light chain from VRC01, as specifically defined herein. VRC01-like antibodies, and methods for identifying and producing these antibodies, are disclosed herein. Generally, these antibodies bind to the CD4 binding surface of gp120 in substantially the same orientation as VRC01, and are broadly neutralizing VRC01-like antibodies mimic the binding of CD4 to gp120 with several of the important contacts between CD4 and gp120 mimicked by the VRC01-like antibodies.

In some embodiments, a VRC07 or VRC07 variant heavy chain variable domain disclosed herein can be included on a heavy chain and cross-complemented with a light chain including a variable domain of a VRC01 like antibody, such as VRC-PG04, VRC-PG04b, VRC-CH30, VRC-CH31, VRC-CH32, VRC-CH33, VRC-CH34, VRC01, VRC02, VRC03, NIH4546, NIH4546 G54W, 3BNC60, 3BNC117, 12A12, 12A21, 1NC9, 1B2530, 8ANC131 or 8ANC134, and maintain high binding affinity for gp120. In further embodiments, a VRC01 variant light chain variable domain disclosed herein can be included on a light chain and cross-complemented with a heavy chain including a variable domain of a VRC01 like antibody, such as VRC-PG04, VRC-PG04b, VRC-CH30, VRC-CH31, VRC-CH32, VRC-CH33, VRC-CH34, VRC01, VRC02, VRC03, NIH4546, NIH4546 G54W, 3BNC60, 3BNC117, 12A12, 12A21, 1NC9, 1B2530, 8ANC131 or 8ANC134, and maintain high binding affinity for gp120.

Several VRC01-like antibodies are available, including:

VRC01-like antibodies, heavy chains and light chains disclosed in PCT International Application No. PCT/US2010/050295, filed Sep. 24, 2010, which is incorporated by reference herein and Wu et al., "Rational design of envelope identifies broadly neutralizing human monoclonal antibodies to HIV-1," Science, 329(5993):856-861, 2010, which is incorporated by reference herein. These include heavy and light chains of the VRC01, VRC02 and VRC03

VRC01-like antibodies, heavy chains and light chains disclosed in Scheid et al., "Sequence and structural convergence of broad and potent HIV antibodies that mimic CD4 binding," Science, 333(6049):1633-1637, 2011, incorporated by reference herein. These include the heavy and light chains of the 3BNC117, 3BNC60, 12A12, 12A21, NIH4546, 8ANC131, 8ANC134, 1B2530, 1NC9 antibodies (corresponding Accession Nos. shown in Table 1, below, and disclosed in WIPO Pub. No. WO 2012/158948 A1, which is incorporated by reference herein) and up to 567 other clonal related antibodies, including those listed in Figures S3, S13, S14 and Table S8 of Scheid et al., which are specifically incorporated by reference herein.

Certain VRC01-like antibodies, heavy chains and light chains disclosed in Wu et al., "Focused evolution of HIV-1 neutralizing antibodies revealed by structures and deep sequencing," Science, 333(6049):1593-1602, 2011, incorporated herein by reference. These certain VRC01-like antibodies, heavy chains and light chains include the heavy and light chains of the VRC-PG04 and VRC-PG04b antibodies (GENBANK® Accession Nos. JN159464 to JN159467, respectively), VRC-CH$_{30}$, VRC-CH31, and VRC-CH32 antibodies (GENBANK® Accession Nos. JN159434 to JN159439, respectively), and VRC-CH33 and VRC-CH34 antibodies (GENBANK® Accession Nos. JN159470 to 159473, respectively) (corresponding SEQ ID NOs for the heavy and light chains of these antibodies are shown in Table 1). These certain VRC01-like antibodies, heavy chains and light chains also include 24 heavy chains from donor 74, 2008 (GENBANK® Accession Nos. JN159440 to JN159463), two heavy chains from donor 45, 2008 (GENBANK® Accession Nos. JN159474 and JN159475) and two light chains from donor 45, 2001 (GENBANK® Accession Nos. JN159468 and JN159469). These certain VRC01-like antibodies, heavy chains and light chains also include 1561 unique sequences associated with neutralizing CDR H3 distributions with at least one low divergent member shown in FIG. 6B and FIG. S16 of Wu et al., Science, 333(6049):1593-1602, 2011 (GENBANK® Accession Nos. JN157873 to JN159433, respectively).

VRC01-like antibodies, heavy chains and light chains disclosed in Diskin et al., "Increasing the potency and breadth of an HIV antibody by using structure-based rational design," Science, 334(6060):1289-93, 2011, incorporated by reference herein and U.S. Pat. App. Pub No. 2012/0288502 A1, incorporated by reference herein. These include the heavy and light chains of the NIH4546 antibody with a G54W amino acid substitution (Kabat numbering) in the heavy chain variable domain.

All the Accession Nos. discussed in this definition of "VRC01-like antibody, heavy chain or light chain," are incorporated by reference as available on Dec. 6, 2012, examples of such Accession Numbers are shown in Table 1.

TABLE 1

VRC01-like antibody heavy and light chains

| Antibody | Heavy chain AA | Light chain AA |
|---|---|---|
| 3BNC117 | EMBL Acc. No. HE584537 | EMBL Acc. No. HE584538 |
| 3BNC60 | EMBL Acc. No. HE584535 | EMBL Acc. No. HE584536 |
| 12A12 | EMBL Acc. No. HE584539 | EMBL Acc. No. HE584540 |
| 12A21 | EMBL Acc. No. HE584541 | EMBL Acc. No. HE584542 |
| NIH4546 | EMBL Acc. No. HE584543 | EMBL Acc. No. HE584544 |
| 8ANC131 | EMBL Acc. No. HE584540 | EMBL Acc. No. HE584550 |
| 8ANC134 | EMBL Acc. No. HE584551 | EMBL Acc. No. HE584552 |
| 1B2530 | EMBL Acc. No. HE584545 | EMBL Acc. No. HE584546 |
| 1NC9 | EMBL Acc. No. HE584547 | EMBL Acc. No. HE584548 |

II. Description of Several Embodiments

A. Neutralizing Monoclonal Antibodies

Isolated monoclonal antibodies that specifically bind gp120 are disclosed herein. The antibodies can be fully human. Also disclosed herein are compositions including these monoclonal antibodies and a pharmaceutically acceptable carrier. Nucleic acids encoding these antibodies, expression vectors including these nucleic acids, and isolated host cells that express the nucleic acids are also provided.

Compositions including the monoclonal antibodies specific for gp120 can be used for research, diagnostic and therapeutic purposes. For example, the monoclonal antibodies disclosed herein can be used to diagnose or treat a subject having an HIV-1 infection and/or AIDS. For example, the antibodies can be used to determine HIV-1 titer in a subject. The antibodies disclosed herein also can be used to study the biology of the human immunodeficiency virus.

The discussion of monoclonal antibodies below refers to isolated monoclonal antibodies that include heavy and light chain variable domains including a CDR1, CDR2 and CDR3 with reference to the IMGT or Kabat numbering scheme (unless the context indicates otherwise). The person of ordinary skill in the art will understand that various CDR numbering schemes (such as the Kabat, Chothia or IMGT numbering schemes) can be used to determine CDR positions.

Disclosed herein is the identification of the VRC07 monoclonal antibody, which specifically binds to the CD4 binding site of the gp120 protein of HIV, and is neutralizing VRC07 is a VRC01-like monoclonal antibody, and includes a novel heavy chain ("VRC07 heavy chain") cross complemented with the light chain of the VRC01 monoclonal antibody. VRC07 heavy chain is a clonal variant of the VRC01 heavy chain. As described in the Examples section, VRC07 has increased binding affinity for gp120, but does not have increased self-reactivity, compared to VRC01. Further disclosed herein are variants of the VRC07 heavy chain and the VRC01 light chain, and cross-complemented monoclonal antibodies including such variants that have increased binding affinity for gp120, but do not have increased self-reactivity compared to VRC01.

The CDR positions of the VRC07 monoclonal antibody heavy chain according to the Kabat and IMGT numbering schemes are shown in FIG. 8. The CDR positions of the VRC01 light chain variable domain according to the Kabat and IMGT numbering schemes are shown in FIG. 8. In several embodiments, reference to particular amino acid substitutions in the heavy or light chains of the disclosed antibodies is made according to the Kabat numbering schemes. For example, the VRC07 heavy chain substitution G54H referenced herein refers to the Kabat numbering scheme. The person of ordinary skill in the art will appreciate that Kabat position G54 of the VRC07 heavy chain variable domain corresponds to position 55 of the linear sequence of the VRC07 heavy chain variable domain (set forth as SEQ ID NO: 2). The linear and Kabat positions of the VRC07 heavy chain variable domain and the VRC01 light chain variable domain are shown in FIG. 8. The person of skill in the art will readily understand use of various CDR and variable domain numbering schemes when referencing particular amino acids of the antibodies disclosed herein.

1. Exemplary Monoclonal Antibodies a. Exemplary Heavy Chains

In some embodiments the antibody includes a heavy chain variable domain and a light chain variable domain, wherein heavy chain variable domain includes the amino acid sequence set forth as SEQ ID NO: 2 (VRC07 heavy chain variable domain), and further includes one or more amino acid substitutions at Kabat positions I37, G54, S58, and T93. As disclosed herein, SEQ ID NO: 40 is a consensus amino acid sequence of the heavy chain variable domain of VRC07 with amino acid substitutions at one, two, three, four, or none of positions I37, G54, S58, and T93 (Kabat numbering):

QVRLSQSGGQMKKPGDSMRISCRASGYEFINCPINWX$_1$RLAPGKRPEWMG

WMKPRX$_2$GAVX$_3$YARQLQGRVTMTRDMYSETAFLELRSLTSDDTAVYFC

X$_4$RGKYCTARDYYNWDFEHWGQGTPVTVSS;

wherein $X_1$ is I or V; $X_2$ is G or H; $X_3$ is S or N; and $X_4$ s T or A.

In some embodiments, the antibody includes a heavy chain variable domain and a light chain variable domain, wherein the heavy chain variable domain includes the HCDR1, HCD2 and/or HCD3 of SEQ ID NO: 40, as defined using the Kabat or IMGT CDR positions wherein the antibody specifically binds gp120, and wherein the antibody is neutralizing. In some embodiments, the antibody includes a heavy chain variable domain and a light chain variable domain, wherein the heavy chain variable domain includes the HCDR1, HCDR2 and HCDR3 of SEQ ID NO: 40, as defined using the Kabat or IMGT CDR positions wherein the antibody specifically binds gp120, and wherein the antibody is neutralizing. The person of ordinary skill in the art is familiar with the Kabat and IMGT CDR positioning in an antibody variable domain sequence.

In some embodiments, the antibody includes a heavy chain variable domain and a light chain variable domain, wherein the heavy chain variable domain includes the HCDR1, HCD2 and/or HCD3 of SEQ ID NO: 2, as defined using the Kabat or IMGT CDR positions, and further includes a FR1 having at least 85%, at least 90%, at least 95%, at least 98%, at least 99% sequence identity with the FR1 (IMGT or Kabat) of SEQ ID NO: 2, a FR1 having at least 85%, at least 90%, at least 95%, at least 98%, at least 99% sequence identity with the FR1 (IMGT or Kabat) of SEQ ID NO: 2, a FR1 having at least 85%, at least 90%, at least 95%, at least 98%, at least 99% sequence identity with the FR1 (IMGT or Kabat) of SEQ ID NO: 2, a FR1 having at least 85%, at least 90%, at least 95%, at least 98%, at least 99% sequence identity with the FR1 (IMGT or Kabat) of SEQ ID NO: 2, wherein the antibody specifically binds gp120, and wherein the antibody is neutralizing.

In some embodiments, the antibody includes a heavy chain variable domain and a light chain variable domain, wherein the heavy chain variable domain includes the HCDR1, HCD2 and/or HCD3 of SEQ ID NO: 2, as defined using the Kabat or IMGT CDR positions, and further includes a G54H substitution, and further includes a FR1 having at least 85%, at least 90%, at least 95%, at least 98%, at least 99% sequence identity with the FR1 (IMGT or Kabat) of SEQ ID NO: 2, a FR1 having at least 85%, at least 90%, at least 95%, at least 98%, at least 99% sequence identity with the FR1 (IMGT or Kabat) of SEQ ID NO: 2, a FR1 having at least 85%, at least 90%, at least 95%, at least 98%, at least 99% sequence identity with the FR1 (IMGT or Kabat) of SEQ ID NO: 2, a FR1 having at least 85%, at least 90%, at least 95%, at least 98%, at least 99% sequence identity with the FR1 (IMGT or Kabat) of SEQ ID NO: 2, wherein the antibody specifically binds gp120, and wherein the antibody is neutralizing.

For example, in some embodiments, the antibody includes a heavy chain variable domain and a light chain variable domain, wherein the heavy chain variable domain includes amino acids 26-33 (CDR1), 51-58 (CDR2) and/or 97-114 (CDR3) of SEQ ID NO: 40 (IMGT), wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein the antibody specifically binds gp120, and wherein the antibody is neutralizing. In some embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and 99-114 (CDR3) of SEQ ID NO: 40 (Kabat), wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is G, wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is H, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and 99-114 (CDR3) of SEQ ID NO: 40 (Kabat), wherein $X_2$ is G and $X_3$ is S, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and 99-114 (CDR3) of SEQ ID NO: 40 (Kabat), wherein $X_2$ is H and $X_3$ is S, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and 99-114 (CDR3) of SEQ ID NO: 40 (Kabat), wherein $X_2$ is G and $X_3$ is N, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and 99-114 (CDR3) of SEQ ID NO: 40 (Kabat), wherein $X_2$ is H and $X_3$ is N, wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

In additional embodiments, the antibody includes a heavy chain variable domain and a light chain variable domain, wherein the heavy chain variable domain includes the amino acid sequence of SEQ ID NO: 40, wherein $X_1$ is I, $X_2$ is H, $X_3$ is S and $X_4$ is T (VRC07 G54H; SEQ ID NO: 32), wherein the antibody specifically binds gp120, and wherein the antibody is neutralizing. In additional embodiments, the antibody includes a heavy chain variable domain and a light chain variable domain, wherein the heavy chain variable domain includes the amino acid sequence of SEQ ID NO: 40, wherein $X_1$ is I, $X_2$ is H, $X_3$ is N and $X_4$ is T (VRC07 G54H, S58N; SEQ ID NO: 258), wherein the antibody specifically binds gp120, and wherein the antibody is neutralizing. In additional embodiments, the antibody includes a heavy chain variable domain and a light chain variable domain, wherein the heavy chain variable domain includes the amino acid sequence of SEQ ID NO: 40, wherein $X_1$ is V, $X_2$ is H, $X_3$ is S and $X_4$ is A (VRC07 I37V, G54H, T93A;

SEQ ID NO: 259), wherein the antibody specifically binds gp120, and wherein the antibody is neutralizing. In additional embodiments, the antibody includes a heavy chain variable domain and a light chain variable domain, wherein the heavy chain variable domain includes the amino acid sequence of SEQ ID NO: 40, wherein $X_1$ is V, $X_2$ is H, $X_3$ is N and $X_4$ is A (VRC07 I37V, G54H, S58N, T93A; SEQ ID NO: 260), wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

The disclosed heavy chain variable domains can be included on a heavy chain that is complemented with a VRC01 light chain or any of the VRC01 light chain variants disclosed herein (such as the antibody light chains described in the next section) to generate a monoclonal antibody that specifically binds to gp120 and is neutralizing. In some embodiments, the heavy chain can be complemented with the light chain of a known VRC01-like antibody (for example the light chain of VRC01 or NIH4546,) to generate a monoclonal antibody that specifically binds to gp120 and is neutralizing VRC01-Like Heavy Chains with G54H Substitution The person of ordinary skill in the art will appreciate that the histidine substitution at Kabat position 54 of the VRC07 heavy chain variable domain disclosed herein can be included on other VRC01-like antibodies, to generate a monoclonal antibody with improved binding affinity of gp120, but which is not self-reactive and/or has low self-reactivity. For example, in several embodiments, the histidine substitution at Kabat position 54 of can be included on the heavy chain variable domain of a VRC01-like antibody, to generate a monoclonal antibody with improved binding affinity of gp120, but which is not self-reactive and/or has low self-reactivity, for example, compared to the VRC01-like antibody in the absence of the histidine substitution at Kabat position 54.

Accordingly, in some embodiments, an isolated VRC01-like monoclonal antibody is provided, wherein the antibody includes a VRC01-like heavy chain and a VRC01-like light chain, wherein the heavy chain further includes substitution of a histidine residue for the residue at position 54 (Kabat numbering) of the heavy chain, wherein the antibody specifically binds gp120 of HIV-1, and wherein the antibody is neutralizing. In some embodiments, the amino acid substitution is a G54H substitution. Non-limiting examples of VRC01-like monoclonal antibody heavy chain variable domains that can be modified with the histidine substitution at Kabat position 54 include the heavy chain variable domains of the VRC01, VRC02, VRC03, NIH4546, VRC-PG04, VRC-PG04b, VRC-CH30, VRC-CH31, VRC-CH32, VRC-CH33, VRC-CH34, 3BNC60, 3BNC117, 12A12, 12A21, 1NC9, 1B2530, 8ANC131 or 8ANC134 monoclonal antibodies. The sequence of accession numbers of the heavy chain variable domains of these antibodies are familiar to the person of ordinary skill in the art and provided herein.

For example, in some embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 196 (NIH4546 heavy chain variable domain, IMGT CDRs), further including a glycine to histidine substitution at Kabat position 54 (a G54H substitution), wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and 99-114 (CDR3) of SEQ ID NO: 196 (NIH4546 heavy chain variable domain, IMGT CDRs), further including a glycine to histidine substitution at Kabat position 54 (a G54H substitution), wherein the antibody specifically binds gp120, and wherein the antibody is neutralizing. In additional embodiments, the antibody includes a heavy chain variable domain and a light chain variable domain, wherein the heavy chain variable domain includes the amino acid sequence set forth as SEQ ID NO: 196, and further including a glycine to histidine substitution at Kabat position 54 (a G54H substitution), wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

b. Exemplary Light Chains

As disclosed herein, SEQ ID NO: 238 is a consensus amino acid sequence of a VRC01-like light chain variable domain with amino acid substitutions at one or more of positions E1, I2, V3, I20, S63, S65, W67, D70, N72, T74, F97, V106, and I108 (Kabat numbering) compared to the light chain variable domain of VRC01:

$X_1X_2X_3$LTQSPGTLSLSPGETA$X_4$ISCRTSQYGSLA WYQQRPGQAPRLVIYSGSTRAAGIPDRF $\underline{X_5}$G$\underline{X_6}$R$\underline{X_7}$ GP$\underline{X_8}$Y$\underline{X_9}$L$\underline{X_{10}}$ISNLESGDFGVYYCQQYE$\underline{X}$ $\underline{{}_{11}}$FGQGTKVQ$\underline{X_{12}}$D$\underline{X_{13}}$K (SEQ ID NO: 238), wherein $X_1$ is E or no amino acid; $X_2$ is I or no amino acid; $X_3$ is V, E, K, or S; $X_4$ is I, Q, E, or T; $X_5$ is S or K; $X_6$ is S or E; $X_7$ is W, S, N or E; $X_8$ is D or E; $X_9$ is N, T or R; $X_{10}$ is T or R; $X_{11}$ is F, D, K, S or H; $X_{12}$ is V or Q; $X_{13}$ is I or N.

In some embodiments, the antibody includes a VRC01-like heavy chain variable domain as disclosed herein and a light chain variable domain, wherein the light chain variable domain includes the LCDR1, LCD2 and/or LCD3 of SEQ ID NO: 238, as defined using the Kabat or IMGT CDR positions, wherein the antibody specifically binds gp120, and wherein the antibody is neutralizing. In some embodiments, the antibody includes a heavy chain variable domain and a light chain variable domain, wherein the light chain variable domain includes the LCDR1, LCDR2 and LCDR3 of SEQ ID NO: 238, as defined using the Kabat or IMGT CDR positions, wherein the antibody specifically binds gp120, and wherein the antibody is neutralizing.

In some embodiments, the antibody includes a light chain variable domain and a light chain variable domain, wherein the light chain variable domain includes the LCDR1, LCD2 and/or LCD3 of SEQ ID NO: 9, as defined using the Kabat or IMGT CDR positions, and further includes a FR1 having at least 85%, at least 90%, at least 95%, at least 98%, at least 99% sequence identity with the FR1 (IMGT or Kabat) of SEQ ID NO: 9, a FR1 having at least 85%, at least 90%, at least 95%, at least 98%, at least 99% sequence identity with the FR1 (IMGT or Kabat) of SEQ ID NO: 9, a FR1 having at least 85%, at least 90%, at least 95%, at least 98%, at least 99% sequence identity with the FR1 (IMGT or Kabat) of SEQ ID NO: 9, a FR1 having at least 85%, at least 90%, at least 95%, at least 98%, at least 99% sequence identity with the FR1 (IMGT or Kabat) of SEQ ID NO: 9, wherein the antibody specifically binds gp120, and wherein the antibody is neutralizing.

In some embodiments, the antibody includes a heavy chain variable domain and a light chain variable domain, wherein the heavy chain variable domain includes the HCDR1, HCD2 and/or HCD3 of SEQ ID NO: 2, as defined using the Kabat or IMGT CDR positions, and further includes an amino acid substitution at Kabat position F97 (such as a F97D, F97K, F97S, F97H), and further includes a FR1 having at least 85%, at least 90%, at least 95%, at least 98%, at least 99% sequence identity with the FR1 (IMGT or Kabat) of SEQ ID NO: 2, a FR1 having at least 85%, at least 90%, at least 95%, at least 98%, at least 99% sequence identity with the FR1 (IMGT or Kabat) of SEQ ID NO: 2, a FR1 having at least 85%, at least 90%, at least 95%, at least 98%, at least 99% sequence identity with the FR1 (IMGT or Kabat) of SEQ ID NO: 2, a FR1 having at least 85%, at least 90%, at least 95%, at least 98%, at least 99% sequence identity with the FR1 (IMGT or Kabat) of SEQ ID NO: 2, wherein the antibody specifically binds gp120, and wherein the antibody is neutralizing.

For example, in some embodiments the antibody includes a heavy chain variable domain and a light chain variable domain, wherein the light chain variable domain includes amino acids 24-32 (CDR1), 48-54 (CDR2) and/or 87-91 (CDR3) of SEQ ID NO: 238 (Kabat). In some embodiments the antibody includes a heavy chain variable domain and a light chain variable domain, wherein the light chain variable domain includes amino acids 24-32 (CDR1), 48-54 (CDR2) and 87-91 (CDR3) of SEQ ID NO: 238 (Kabat). In additional embodiments the antibody includes a heavy chain variable domain and a light chain variable domain, wherein the light chain variable domain includes amino acids 27-30 (CDR1), 48-50 (CDR2) and/or 87-91 (CDR3) of SEQ ID NO: 238 (IMGT). In some embodiments the antibody includes a heavy chain variable domain and a light chain variable domain, wherein the light chain variable domain includes amino acids 27-30 (CDR1), 48-50 (CDR2) and 87-91 (CDR3) of SEQ ID NO: 238 (IMGT). In several embodiments, the antibody is not self-reactive, and/or has low self-reactivity. In additional embodiments, the antibody is not immunogenic and/or has low immunogenicity.

In some examples the light chain of the antibody includes the LCDR1, LCDR2, and/or LCD3 of SEQ ID NO: 238, and further includes an amino acid substitution at Kabat position F97, which is included in the LCDR3 of SEQ ID NO: 238 using either Kabat or IMGT positioning. For example, in some embodiments the antibody includes a heavy chain variable domain and a light chain variable domain, wherein the light chain variable domain includes amino acids 24-32 (CDR1), 48-54 (CDR2) and 87-91 (CDR3) of SEQ ID NO: 238, wherein $X_{11}$ is F (VRC01 light chain Kabat CDRs with F97), wherein the antibody specifically binds gp120, and wherein the antibody is neutralizing. In some embodiments the antibody includes a heavy chain variable domain and a light chain variable domain, wherein the light chain variable domain includes amino acids 24-32 (CDR1), 48-54 (CDR2) and 87-91 (CDR3) of SEQ ID NO: 238, wherein $X_{11}$ is D (VRC01 light chain Kabat CDRs with F97D), wherein the antibody specifically binds gp120, and wherein the antibody is neutralizing. In additional embodiments the antibody includes a heavy chain variable domain and a light chain variable domain, wherein the light chain variable domain includes amino acids 24-32 (CDR1), 48-54 (CDR2) and 87-91 (CDR3) of SEQ ID NO: 238, wherein $X_{11}$ is K (VRC01 light chain Kabat CDRs with F97K), wherein the antibody specifically binds gp120, and wherein the antibody is neutralizing. In additional embodiments the antibody includes a heavy chain variable domain and a light chain variable domain, wherein the light chain variable domain includes amino acids 24-32 (CDR1), 48-54 (CDR2) and 87-91 (CDR3) of SEQ ID NO: 238, wherein $X_{11}$ is S (VRC01 light chain Kabat CDRs with F97S), wherein the antibody specifically binds gp120, and wherein the antibody is neutralizing.

In additional embodiments the antibody includes a heavy chain variable domain and a light chain variable domain, wherein the light chain variable domain includes amino acids 24-32 (CDR1), 48-54 (CDR2) and 87-91 (CDR3) of SEQ ID NO: 238, wherein $X_{11}$ is H (VRC01 light chain Kabat CDRs with F97H), wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

In additional embodiments the antibody includes a heavy chain variable domain and a light chain variable domain, wherein the light chain variable domain includes amino acids 27-30 (CDR1), 48-50 (CDR2) and 87-91 (CDR3) of SEQ ID NO: 238, wherein $X_{11}$ is F (VRC01 light chain IMGT CDRs with F97), wherein the antibody specifically binds gp120, and wherein the antibody is neutralizing. In additional embodiments the antibody includes a heavy chain variable domain and a light chain variable domain, wherein the light chain variable domain includes amino acids 27-30 (CDR1), 48-50 (CDR2) and 87-91 (CDR3) of SEQ ID NO: 238, wherein $X_{11}$ is D (VRC01 light chain IMGT CDRs with F97D), wherein the antibody specifically binds gp120, and wherein the antibody is neutralizing. In additional embodiments the antibody includes a heavy chain variable domain and a light chain variable domain, wherein the light chain variable domain includes amino acids 27-30 (CDR1), 48-50 (CDR2) and 87-91 (CDR3) of SEQ ID NO: 238, wherein $X_{11}$ is K (VRC01 light chain IMGT CDRs with F97K), wherein the antibody specifically binds gp120, and wherein the antibody is neutralizing. In additional embodiments the antibody includes a heavy chain variable domain and a light chain variable domain, wherein the light chain variable domain includes amino acids 27-30 (CDR1), 48-50 (CDR2) and 87-91 (CDR3) of SEQ ID NO: 238, wherein $X_{11}$ is S (VRC01 light chain IMGT CDRs with F97S), wherein the antibody specifically binds gp120, and wherein the antibody is neutralizing. In additional embodiments the antibody includes a heavy chain variable domain and a light chain variable domain, wherein the light chain variable domain includes amino acids 27-30 (CDR1), 48-50 (CDR2) and 87-91 (CDR3) of SEQ ID NO: 238, wherein $X_{11}$ is H (VRC01 light chain IMGT CDRs with F97H), wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

VRC01L

In some embodiments the antibody includes a heavy chain variable domain and a light chain variable domain, wherein the light chain variable domain includes the amino acid sequence set forth as SEQ ID NO: 238, wherein $X_1$ is E; $X_2$ is I; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01 light chain; SEQ ID NO: 9). The light chain can be complemented with any of the VRC07 heavy chain variants disclosed herein (such as the antibody heavy chains described in the above section) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 Deletion, V3E

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01L V3E light chain; SEQ ID NO: 219). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 Deletion, V3K

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is K; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01L V3K light chain; SEQ ID NO: 220). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 deletion, V3S

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is S; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01L V3S light chain; SEQ ID NO: 221). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 deletion, F97D

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is D; $X_{12}$ is V; $X_{13}$ is I (VRC01L F97D light chain; SEQ ID NO: 222). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 deletion, F97K

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is K; $X_{12}$ is V; $X_{13}$ is I (VRC01L F97K light chain; SEQ ID NO: 223). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 Deletion, F97S

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is S; $X_{12}$ is V; $X_{13}$ is I (VRC01L F97S light chain; SEQ ID NO: 224). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 Deletion, F97H

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is V; $X_4$ is I; $X_5$ is S; $X_6$ is S; $X_7$ is W; X8 is D; $X_9$ is N; $X_{10}$ is T; $X_{11}$ is H; $X_{12}$ is V; $X_{13}$ is I (VRC01L F97H light chain; SEQ ID NO: 225).

The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 Deletion, V3E/F97S

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is S; $X_{12}$ is V; $X_{13}$ is I (VRC01L V3E/F97S light chain; SEQ ID NO:226). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 Deletion, V3E/F97H

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is H; $X_{12}$ is V; $X_{13}$ is I (VRC01L V3E/F97H light chain; SEQ ID NO: 227). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL03

In some embodiments the antibody includes a heavy chain variable domain and a light chain variable domain, wherein the light chain variable domain includes the amino acid sequence set forth as SEQ ID NO: 238, wherein $X_1$ is E; $X_2$ is I; $X_3$ is V; $X_4$ is I; $X_5$ is S; $X_6$ is S; $X_7$ is S; $X_8$ is D; $X_9$ is T; $X_{10}$ is T; $X_{11}$ is F; $X_{12}$ is V; $X_{13}$ is I (VRC01hpL03 light chain; SEQ ID NO: 228). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL04

In some embodiments the antibody includes a heavy chain variable domain and a light chain variable domain, wherein the light chain variable domain includes the amino acid sequence set forth as SEQ ID NO: 238, wherein $X_1$ is E; $X_2$ is I; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is V; $X_{13}$ is I (VRC01hpL04 light chain; SEQ ID NO: 229). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL05

In some embodiments the antibody includes a heavy chain variable domain and a light chain variable domain, wherein the light chain variable domain includes the amino acid sequence set forth as SEQ ID NO: 238, wherein $X_1$ is E; $X_2$ is I; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; $X_{13}$ is N (VRC01hpL05 light chain; SEQ ID NO: 230). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL06

In some embodiments the antibody includes a heavy chain variable domain and a light chain variable domain, wherein the light chain variable domain includes the amino acid sequence set forth as SEQ ID NO: 238, wherein $X_1$ is E; $X_2$ is I; $X_3$ is V; $X_4$ is E; $X_5$ is K; $X_6$ is E; $X_7$ is E; $X_8$ is E; $X_9$ is R; $X_{10}$ is R; $X_{11}$ is F; $X_{12}$ is Q; $X_{13}$ is N (VRC01hpL06 light chain; SEQ ID NO: 231). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL02 E1/I2 deletion/V3S

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is S; $X_4$ is T; $X_5$ is S; $X_6$ is S; $X_7$ is S; $X_8$ is D; $X_9$ is T; $X_{10}$ is T; $X_{11}$ is F; $X_{12}$ is Q; $X_{13}$ is N (VRC01hpL02 E1/I2 deletion/V3S light chain; SEQ ID NO: 232). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL03 E1/I2 Deletion/V3S

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is S; $X_4$ is I; $X_5$ is S; $X_6$ is S; $X_7$ is S; $X_8$ is D; $X_9$ is T; $X_{10}$ is T; $X_{11}$ is F; $X_{12}$ is V; $X_{13}$ is I (VRC01hpL03 E1/I2 deletion/V3S light chain; SEQ ID NO: 233). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL04 E1/I2 Deletion/V3S

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is V; $X_{13}$ is I (VRC01hpL04 E1/I2 deletion/V3S light chain; SEQ ID NO: 234). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL05 E1/I2 Deletion/V3S

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; $X_{13}$ is N (VRC01hpL05 E1/I2 deletion/V3S light chain; SEQ ID NO: 235). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL06 E1/I2 Deletion/V3S

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is S; $X_4$ is E; $X_5$ is K; $X_6$ is E; $X_7$ is E; $X_8$ is E; $X_9$ is R; $X_{10}$ is R; $X_{11}$ is F; $X_{12}$ is Q; $X_{13}$ is N (VRC01hpL06 E1/I2 deletion/V3S light chain; SEQ ID NO: 236). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL04 E1/I2 Deletion/V3E

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is E; $X_4$ is Q; $X_5$ is S; $X_6$ is S; $X_7$ is N; $X_8$ is D; $X_9$ is T; $X_{10}$ is T; $X_{11}$ is F; $X_{12}$ is V; $X_{13}$ is I (VRC01hpL04 E1/I2 deletion/V3E light chain; SEQ ID NO: 237). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01L E1/I2 Deletion

In some embodiments the antibody includes a heavy chain variable domain and a light chain variable domain, wherein the light chain variable domain includes the amino acid sequence set forth as SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01L E1/I2 deletion; SEQ ID NO: 53). The light chain can be complemented with any of the VRC07 heavy chain variants disclosed herein (such as the antibody heavy chains described in the above section) to generate a monoclonal antibody that specifically binds to gp120 and is neutralizing. In several embodiments, the antibody is not self-reactive, and/or has low self-reactivity. In additional embodiments, the antibody is not immunogenic and/or has low immunogenicity.

VRC01hpL02

In some embodiments the antibody includes a heavy chain variable domain and a light chain variable domain, wherein the light chain variable domain includes the amino acid sequence set forth as SEQ ID NO: 238, wherein $X_1$ is E; $X_2$ is I; $X_3$ is S; $X_4$ is T; $X_5$ is S; $X_6$ is S; $X_7$ is S; $X_8$ is D; $X_9$ is T; $X_{10}$ is T; $X_{11}$ is F; $X_{12}$ is Q; $X_{13}$ is N (VRC01hpL02; SEQ ID NO: 50). The light chain can be complemented with VRC07 heavy chain or any of the VRC07 heavy chain variants disclosed herein (such as the antibody heavy chains described in the above section) to generate a monoclonal antibody that specifically binds to gp120 and is neutralizing. In some embodiments, the light chain can be complemented with the heavy chain of a known VRC01-like antibody (for example the heavy chain of VRC01, NIH4546, or NIH4546 G54W) to generate a monoclonal antibody that specifically binds to gp120 and is neutralizing.

VRC01-Like Light Chains with E1/E2 Deletion

The person of ordinary skill in the art will appreciate that deletion of the first two amino acids of the VRC07 light chain variable domain disclosed herein can be included on other VRC01-like antibodies, to generate a monoclonal antibody with improved binding affinity of gp120, but which does not have increased self-reactivity, compared to the VRC01-like antibody in the absence of the deletion of the first two amino acids of the light chain. Accordingly, in some embodiments, an isolated VRC01-like monoclonal antibody is provided, wherein the antibody includes a VRC01-like heavy chain and a VRC01-like light chain, wherein the light chain further includes deletion of the first two amino acids of the light chain, wherein the antibody specifically binds gp120 of HIV-1, and wherein the antibody is neutralizing. In some embodiments, the deletion includes and E1, I2 deletion. Non-limiting examples of VRC01-like monoclonal antibody light chain variable domains that can be modified with the deletion of the first two amino acids of the light chain include the light chain variable domains of the VRC01, VRC02, VRC03, NIH4546, NIH4546 G54W, VRC-PG04, VRC-PG04b, VRC-CH30, VRC-CH31, VRC-CH32, VRC-CH33, VRC-CH34, 3BNC60, 3BNC117, 12A12, 12A21, 1NC9, 1B2530, 8ANC131 or 8ANC134 monoclonal antibodies. The sequence of accession numbers of the heavy chain variable domains of these antibodies are familiar to the person of ordinary skill in the art and provided herein.

c. Exemplary Combinations of Heavy and Light Chains

The person of ordinary skill in the art will appreciate that the disclosed heavy and light chain variable domains can be included on heavy and light chains and cross-complemented to generate a monoclonal antibody that specifically binds to gp120 and is neutralizing. In several embodiments, the disclosed antibodies have increased binding affinity for gp120 compared to VRC01, but are not self-reactive, and/or have low self-reactivity. In additional embodiments, the antibody is not immunogenic and/or has low immunogenicity.

For example, in some embodiments, the antibody includes a heavy chain variable domain and a light chain variable domain, wherein the antibody specifically binds gp120, and wherein the antibody is neutralizing, wherein the heavy chain variable domain includes amino acids 31-35 (CDR1), 50-66 (CDR2) and/or 99-114 (CDR3) of SEQ ID NO: 40 (Kabat), and the light chain variable domain of the antibody includes amino acids 24-32 (CDR1), 48-54 (CDR2) and/or 87-91 (CDR3) of SEQ ID NO: 238 (Kabat). In some embodiments, the antibody includes a heavy chain variable domain and a light chain variable domain, wherein the antibody specifically binds gp120, and wherein the antibody is neutralizing, wherein the heavy chain variable domain includes amino acids 31-35 (CDR1), 50-66 (CDR2) and 99-114 (CDR3) of SEQ ID NO: 40 (Kabat), and the light chain variable domain of the antibody includes amino acids 24-32 (CDR1), 48-54 (CDR2) and 87-91 (CDR3) of SEQ ID NO: 238 (Kabat).

In some embodiments, the antibody includes a heavy chain variable domain and a light chain variable domain, wherein the antibody specifically binds gp120, and wherein the antibody is neutralizing, wherein the heavy chain variable domain includes amino acids 26-33 (CDR1), 51-58 (CDR2) and/or 97-114 (CDR3) of SEQ ID NO: 40 (IMGT), and the light chain variable domain of the antibody includes amino acids 27-30 (CDR1), 48-50 (CDR2) and/or 87-91 (CDR3) of SEQ ID NO: 238 (IMGT). In some embodiments, the antibody includes a heavy chain variable domain and a light chain variable domain, wherein the antibody specifically binds gp120, and wherein the antibody is neutralizing, wherein the heavy chain variable domain includes amino acids 26-33 (CDR1), 51-58 (CDR2) and 97-114 (CDR3) of SEQ ID NO: 40 (IMGT), and the light chain variable domain of the antibody includes amino acids 27-30 (CDR1), 48-50 (CDR2) and 87-91 (CDR3) of SEQ ID NO: 238 (IMGT). In several embodiments, the antibody is not self-reactive, and/or has low self-reactivity. In additional embodiments, the antibody is not immunogenic and/or has low immunogenicity.

In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is G, wherein the light chain variable domain includes amino acids 27-30 (CDR1), 48-50 (CDR2) and 87-91 (CDR3) of SEQ ID NO: 238, wherein $X_{11}$ is F, wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is G, wherein the light chain variable domain includes amino acids 27-30 (CDR1), 48-50 (CDR2) and 87-91 (CDR3) of SEQ ID NO: 238, wherein $X_{11}$ is D, wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58

(CDR2) and 97-114 (CDR3) of SEQ ID NO: 40 (IMGT), wherein $X_2$ is G, wherein the light chain variable domain includes amino acids 27-30 (CDR1), 48-50 (CDR2) and 87-91 (CDR3) of SEQ ID NO: 238, wherein $X_{11}$ is K, wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is G, wherein the light chain variable domain includes amino acids 27-30 (CDR1), 48-50 (CDR2) and 87-91 (CDR3) of SEQ ID NO: 238, wherein $X_{11}$ is S, wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is G, wherein the light chain variable domain includes amino acids 27-30 (CDR1), 48-50 (CDR2) and 87-91 (CDR3) of SEQ ID NO: 238, wherein $X_{11}$ is H, wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is H, wherein the light chain variable domain includes amino acids 27-30 (CDR1), 48-50 (CDR2) and 87-91 (CDR3) of SEQ ID NO: 238, wherein $X_{11}$ is F, wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is H, wherein the light chain variable domain includes amino acids 27-30 (CDR1), 48-50 (CDR2) and 87-91 (CDR3) of SEQ ID NO: 238, wherein $X_{11}$ is D, wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is H, wherein the light chain variable domain includes amino acids 27-30 (CDR1), 48-50 (CDR2) and 87-91 (CDR3) of SEQ ID NO: 238, wherein $X_{11}$ is K, wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is H, wherein the light chain variable domain includes amino acids 27-30 (CDR1), 48-50 (CDR2) and 87-91 (CDR3) of SEQ ID NO: 238, wherein $X_{11}$ is S, wherein the antibody specifically binds gp120, and wherein the antibody is neutralizing. In additional embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 40 (IMGT), wherein $X_2$ is H, wherein the light chain variable domain includes amino acids 27-30 (CDR1), 48-50 (CDR2) and 87-91 (CDR3) of SEQ ID NO: 238, wherein $X_{11}$ is H, wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is F, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is D, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is K, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is S, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is H, wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is F, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is D, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is K, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is S, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is S, wherein the light chain variable domain includes amino acids 24-32 (CDR1), 48-54 (CDR2) and/or 87-91 (CDR3) of SEQ ID NO: 238 (Kabat), wherein $X_{11}$ is H, wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is F, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is D, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is K, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is S, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is G and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is H, wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is F, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is D, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is K, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is S, wherein the antibody specifically binds gp120, and wherein the antibody is neutralizing. In additional embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 40 (Kabat), wherein $X_2$ is H and $X_3$ is N, wherein the light chain variable domain includes amino acids 24-32 (CDR1), 48-54 (CDR2) and/or 87-91 (CDR3) of SEQ ID NO: 238 (Kabat), wherein $X_{11}$ is H, wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

For example, in some embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 196 (NIH4546 heavy chain variable domain, IMGT CDRs), further including a glycine to histidine substitution at Kabat position 54 (a G54H substitution), and wherein the light chain variable domain includes amino acids 27-30 (CDR1), 48-50 (CDR2) and 87-91 (CDR3) of SEQ ID NO: 215 (IMGT), wherein the antibody specifically binds gp120, and wherein the antibody is neutralizing. In some embodiments, the antibody includes a heavy chain variable domain and a light chain variable domain, wherein the heavy chain variable domain includes amino acids 26-33 (CDR1), 51-58 (CDR2) and 97-114 (CDR3) of SEQ ID NO: 196 (NIH4546 heavy chain variable domain, IMGT CDRs), further including a glycine to histidine substitution at Kabat position 54 (a G54H substitution), and wherein the light chain variable domain includes amino acids 27-30 (CDR1), 48-50 (CDR2) and 87-91 (CDR3) of SEQ ID NO: 215 (IMGT), wherein the antibody specifically binds gp120, and wherein the antibody is neutralizing. For example, in some embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 196 (NIH4546 heavy chain variable domain, Kabat CDRs), further including a glycine to histidine substitution at Kabat position 54 (a G54H substitution), and wherein the light chain variable domain includes amino acids 24-32 (CDR1), 48-54 (CDR2) and/or 87-91 (CDR3) of SEQ ID NO: 215 (Kabat), wherein the antibody specifically binds gp120, and wherein the antibody is neutralizing. In some embodiments, the antibody includes a heavy chain variable domain and a light chain variable domain, wherein the heavy chain variable domain includes amino acids 31-35 (CDR1), 50-66 (CDR2) and/or 99-114 (CDR3) of SEQ ID NO: 196 (NIH4546 heavy chain variable domain, Kabat CDRs), further including a glycine to histidine substitution at Kabat position 54 (a G54H substitution), and wherein the light chain variable domain includes amino acids 24-32 (CDR1), 48-54 (CDR2) and/or 87-91 (CDR3) of SEQ ID NO: 215 (Kabat), wherein the antibody specifically binds gp120, and wherein the antibody is neutralizing. In further embodiments, the antibody includes a heavy chain variable domain and a light chain variable domain, wherein the heavy chain variable domain includes the amino acid sequence set forth as SEQ ID NO: 196 (NIH4546 heavy chain variable domain), further including a glycine to histidine substitution at Kabat position 54 (a G54H substitution), and wherein the light chain variable domain includes the amino acid sequence set forth as SEQ ID NO: 215 (Kabat), wherein the antibody specifically binds gp120, and wherein the antibody is neutralizing. In several embodiments, the antibody is not self-reactive, and/or has low self-reactivity. In additional embodiments, the antibody is not immunogenic and/or has low immunogenicity.

In some embodiments, the antibody includes a heavy chain variable domain and a light chain variable domain, wherein the antibody specifically binds gp120, and wherein the antibody is neutralizing, wherein the heavy chain variable domain includes the amino acid sequence of SEQ ID NO: 40, wherein $X_1$ is I, $X_2$ is H, $X_3$ is S and $X_4$ is T (VRC07 G54H; SEQ ID NO: 32) and wherein the light chain variable domain includes a light chain variable domain as described herein, or a known VRC01-like light chain variable domain. In several embodiments, the antibody is not self-reactive, and/or has low self-reactivity. In additional embodiments, the antibody is not immunogenic and/or has low immunogenicity. For example, in some embodiments, the antibody includes a heavy chain variable domain and a light chain variable domain, wherein the antibody specifically binds gp120, and wherein the antibody is neutralizing, wherein the heavy chain variable domain of the antibody includes SEQ ID NO: 40, wherein $X_1$ is I, $X_2$ is H, $X_3$ is S and $X_4$ is T (VRC07 G54H; SEQ ID NO: 32), and the light chain of the antibody includes:

(a) SEQ ID NO: 238, wherein $X_1$ is E; $X_2$ is I; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01 light chain; SEQ ID NO: 9);

(b) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del-V3E; SEQ ID NO: 219);

(c) SEQ ID NO: 238, wherein $X_1$ is no amino acid; $X_2$ is no amino acid; $X_3$ is K; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L V3K light chain; SEQ ID NO: 220);

(d) SEQ ID NO: 238, wherein $X_1$ is no amino acid; $X_2$ is no amino acid; $X_3$ is S; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del V3S light chain; SEQ ID NO: 221);

(e) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is D; $X_{12}$ is V; and $X_{13}$ is I (VRC01L E1/I2del F97D; SEQ ID NO: 222);

(f) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is K; $X_{12}$ is V; and $X_{13}$ is I (VRC01L E1/I2del F97K; SEQ ID NO: 223);

(g) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del F97S; SEQ ID NO: 224);

(h) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del F97H; SEQ ID NO: 225);

(i) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del V3E/F97S; SEQ ID NO: 226);

(j) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del V3E/F97H; SEQ ID NO: 227);

(k) SEQ ID NO: 238, wherein $X_1$ is no amino acid; $X_2$ is no amino acid; $X_3$ is V; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03; SEQ ID NO: 228);

(l) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04; SEQ ID NO: 229);

(m) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05; SEQ ID NO: 230);

(n) SEQ ID NO: 238, wherein $X_1$ is no amino acid; $X_2$ is no amino acid; $X_3$ is V; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06; SEQ ID NO: 231); (o) SEQ ID NO: 238, wherein $X_1$ is no amino acid; $X_2$ is no amino acid; $X_3$ is S; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02 E1/I2 deletion/V3S; SEQ ID NO: 232);

(p) SEQ ID NO: 238, wherein $X_1$ is no amino acid; $X_2$ is no amino acid; $X_3$ is S; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03 E1/I2 deletion/V3S; SEQ ID NO: 233);

(q) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3S; SEQ ID NO: 234);

(r) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05 E1/I2 deletion/V3S; SEQ ID NO: 235);

(s) SEQ ID NO: 238, wherein $X_1$ is no amino acid; $X_2$ is no amino acid; $X_3$ is S; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06 E1/I2 deletion/V3S; SEQ ID NO: 236);

(t) SEQ ID NO: 238, wherein $X_1$ is no amino acid; $X_2$ is no amino acid; $X_3$ is E; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3E; SEQ ID NO: 237);

(u) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01 E1/I2 deletion; SEQ ID NO: 53); or (v) SEQ ID NO: 238, wherein $X_1$ is no amino acid; $X_2$ is no amino acid; $X_3$ is V; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02; SEQ ID NO: 50).

In some embodiments, the antibody includes a heavy chain variable domain and a light chain variable domain, wherein the antibody specifically binds gp120, and wherein the antibody is neutralizing, wherein the heavy chain variable domain includes the amino acid sequence of SEQ ID NO: 40, wherein $X_1$ is I, $X_2$ is H, $X_3$ is N and $X_4$ is T (VRC07 G54H, S58N), and wherein the light chain variable domain includes a light chain variable domain as described herein, or a known VRC01-like light chain variable domain. In several embodiments, the antibody is not self-reactive, and/or has low self-reactivity. In additional embodiments, the antibody is not immunogenic and/or has low immunogenicity. For example, in some embodiments, the antibody includes a heavy chain variable domain and a light chain variable domain, wherein the antibody specifically binds gp120, and wherein the antibody is neutralizing, wherein the heavy chain variable domain of the antibody includes SEQ ID NO: 40, wherein $X_1$ is I, $X_2$ is H, $X_3$ is N and $X_4$ is T (VRC07 G54H, S58N; SEQ ID NO: 258), and the light chain of the antibody includes:

(a) SEQ ID NO: 238, wherein $X_1$ is E; $X_2$ is I; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01 light chain; SEQ ID NO: 9);

(b) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del-V3E; SEQ ID NO: 219);

(c) SEQ ID NO: 238, wherein $X_1$ is no amino acid; $X_2$ is no amino acid; $X_3$ is K; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L V3K light chain; SEQ ID NO: 220);

(d) SEQ ID NO: 238, wherein $X_1$ is no amino acid; $X_2$ is no amino acid; $X_3$ is S; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del V3S light chain; SEQ ID NO: 221);

(e) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is D; $X_{12}$ is V; and $X_{13}$ is I (VRC01L E1/I2del F97D; SEQ ID NO: 222);

(f) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is K; $X_{12}$ is V; and $X_{13}$ is I (VRC01L E1/I2del F97K; SEQ ID NO: 223);

(g) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del F97S; SEQ ID NO: 224);

(h) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del F97H; SEQ ID NO: 225);

(i) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del V3E/F97S; SEQ ID NO: 226);

(j) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del V3E/F97H; SEQ ID NO: 227);

(k) SEQ ID NO: 238, wherein $X_1$ is no amino acid; $X_2$ is no amino acid; $X_3$ is V; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03; SEQ ID NO: 228);

(l) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04; SEQ ID NO: 229);

(m) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05; SEQ ID NO: 230);

(n) SEQ ID NO: 238, wherein $X_1$ is no amino acid; $X_2$ is no amino acid; $X_3$ is V; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06; SEQ ID NO: 231);

(o) SEQ ID NO: 238, wherein $X_1$ is no amino acid; $X_2$ is no amino acid; $X_3$ is S; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02 E1/I2 deletion/V3S; SEQ ID NO: 232);

(p) SEQ ID NO: 238, wherein $X_1$ is no amino acid; $X_2$ is no amino acid; $X_3$ is S; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03 E1/I2 deletion/V3S; SEQ ID NO: 233);

(q) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3S; SEQ ID NO: 234);

(r) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05 E1/I2 deletion/V3S; SEQ ID NO: 235);

(s) SEQ ID NO: 238, wherein $X_1$ is no amino acid; $X_2$ is no amino acid; $X_3$ is S; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06 E1/I2 deletion/V3S; SEQ ID NO: 236);

(t) SEQ ID NO: 238, wherein $X_1$ is no amino acid; $X_2$ is no amino acid; $X_3$ is E; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3E; SEQ ID NO: 237);

(u) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01 E1/I2 deletion; SEQ ID NO: 53); or (v) SEQ ID NO: 238, wherein $X_1$ is no amino acid; $X_2$ is no amino acid; $X_3$ is V; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02; SEQ ID NO: 50).

In some embodiments, the antibody includes a heavy chain variable domain and a light chain variable domain, wherein the antibody specifically binds gp120, and wherein the antibody is neutralizing, wherein the heavy chain variable domain includes the amino acid sequence of SEQ ID NO: 40, wherein $X_1$ is V, $X_2$ is H, $X_3$ is S and $X_4$ is A (VRC07 I37V, G54H, T93A; SEQ ID NO: 259), and wherein the light chain variable domain includes a light chain variable domain as described herein, or a known VRC01-like light chain variable domain. In several embodiments, the antibody is not self-reactive, and/or has low self-reactivity. In additional embodiments, the antibody is not immunogenic and/or has low immunogenicity. For example, in some embodiments, the antibody includes a heavy chain variable domain and a light chain variable domain, wherein the antibody specifically binds gp120, and wherein the antibody is neutralizing, wherein the heavy chain variable domain of the antibody includes SEQ ID NO: 40, wherein $X_1$ is V, $X_2$ is H, $X_3$ is S and $X_4$ is A (VRC07 I37V, G54H, T93A; SEQ ID NO: 259), and the light chain of the antibody includes:

(a) SEQ ID NO: 238, wherein $X_1$ is E; $X_2$ is I; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01 light chain; SEQ ID NO: 9);

(b) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del-V3E; SEQ ID NO: 219);

(c) SEQ ID NO: 238, wherein $X_1$ is no amino acid; $X_2$ is no amino acid; $X_3$ is K; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L V3K light chain; SEQ ID NO: 220);

(d) SEQ ID NO: 238, wherein $X_1$ is no amino acid; $X_2$ is no amino acid; $X_3$ is S; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del V3S light chain; SEQ ID NO: 221);

(e) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is D; $X_{12}$ is V; and $X_{13}$ is I (VRC01L E1/I2del F97D; SEQ ID NO: 222);

(f) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is K; $X_{12}$ is V; and $X_{13}$ is I (VRC01L E1/I2del F97K; SEQ ID NO: 223);

(g) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del F97S; SEQ ID NO: 224);

(h) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del F97H; SEQ ID NO: 225);

(i) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del V3E/F97S; SEQ ID NO: 226);

(j) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del V3E/F97H; SEQ ID NO: 227);

(k) SEQ ID NO: 238, wherein $X_1$ is no amino acid; $X_2$ is no amino acid; $X_3$ is V; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03; SEQ ID NO: 228);

(l) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04; SEQ ID NO: 229);

(m) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05; SEQ ID NO: 230);

(n) SEQ ID NO: 238, wherein $X_1$ is no amino acid; $X_2$ is no amino acid; $X_3$ is V; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06; SEQ ID NO: 231);

(o) SEQ ID NO: 238, wherein $X_1$ is no amino acid; $X_2$ is no amino acid; $X_3$ is S; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02 E1/I2 deletion/V3S; SEQ ID NO: 232);

(p) SEQ ID NO: 238, wherein $X_1$ is no amino acid; $X_2$ is no amino acid; $X_3$ is S; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03 E1/I2 deletion/V3S; SEQ ID NO: 233);

(q) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3S; SEQ ID NO: 234);

(r) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05 E1/I2 deletion/V3S; SEQ ID NO: 235);

(s) SEQ ID NO: 238, wherein $X_1$ is no amino acid; $X_2$ is no amino acid; $X_3$ is S; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06 E1/I2 deletion/V3S; SEQ ID NO: 236);

(t) SEQ ID NO: 238, wherein $X_1$ is no amino acid; $X_2$ is no amino acid; $X_3$ is E; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3E; SEQ ID NO: 237);

(u) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01 E1/I2 deletion; SEQ ID NO: 53); or (v) SEQ ID NO: 238, wherein $X_1$ is no amino acid; $X_2$ is no amino acid; $X_3$ is V; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02; SEQ ID NO: 50).

In some embodiments, the antibody includes a heavy chain variable domain and a light chain variable domain, wherein the antibody specifically binds gp120, and wherein the antibody is neutralizing, wherein the heavy chain variable domain includes the amino acid sequence of SEQ ID NO: 40, wherein $X_1$ is V, $X_2$ is H, $X_3$ is N and $X_4$ is A (VRC07 I37V, G54H, S58N, T93A; SEQ ID NO: 260), and wherein the light chain variable domain includes a light chain variable domain as described herein, or a known VRC01-like light chain variable domain. In several embodiments, the antibody is not self-reactive, and/or has low self-reactivity. In additional embodiments, the antibody is not immunogenic and/or has low immunogenicity. For example, in some embodiments, the antibody includes a heavy chain variable domain and a light chain variable domain, wherein the antibody specifically binds gp120, and wherein the antibody is neutralizing, wherein the heavy chain variable domain of the antibody includes SEQ ID NO: 40, wherein $X_1$ is V, $X_2$ is H, $X_3$ is N and $X_4$ is A (VRC07 I37V, G54H, S58N, T93A; SEQ ID NO: 260), and the light chain of the antibody includes:

(a) SEQ ID NO: 238, wherein $X_1$ is E; $X_2$ is I; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01 light chain; SEQ ID NO: 9);

(b) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del-V3E; SEQ ID NO: 219);

(c) SEQ ID NO: 238, wherein $X_1$ is no amino acid; $X_2$ is no amino acid; $X_3$ is K; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L V3K light chain; SEQ ID NO: 220);

(d) SEQ ID NO: 238, wherein $X_1$ is no amino acid; $X_2$ is no amino acid; $X_3$ is S; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del V3S light chain; SEQ ID NO: 221);

(e) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is D; $X_{12}$ is V; and $X_{13}$ is I (VRC01L E1/I2del F97D; SEQ ID NO: 222);

(f) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is K; $X_{12}$ is V; and $X_{13}$ is I (VRC01L E1/I2del F97K; SEQ ID NO: 223);

(g) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del F97S; SEQ ID NO: 224);

(h) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del F97H; SEQ ID NO: 225);

(i) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del V3E/F97S; SEQ ID NO: 226);

(j) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del V3E/F97H; SEQ ID NO: 227);

(k) SEQ ID NO: 238, wherein $X_1$ is no amino acid; $X_2$ is no amino acid; $X_3$ is V; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03; SEQ ID NO: 228);

(l) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04; SEQ ID NO: 229);

(m) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05; SEQ ID NO: 230);

(n) SEQ ID NO: 238, wherein $X_1$ is no amino acid; $X_2$ is no amino acid; $X_3$ is V; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06; SEQ ID NO: 231);

(o) SEQ ID NO: 238, wherein $X_1$ is no amino acid; $X_2$ is no amino acid; $X_3$ is S; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02 E1/I2 deletion/V3S; SEQ ID NO: 232);

(p) SEQ ID NO: 238, wherein $X_1$ is no amino acid; $X_2$ is no amino acid; $X_3$ is S; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03 E1/I2 deletion/V3S; SEQ ID NO: 233);

(q) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3S; SEQ ID NO: 234);

(r) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05 E1/I2 deletion/V3S; SEQ ID NO: 235);

(s) SEQ ID NO: 238, wherein $X_1$ is no amino acid; $X_2$ is no amino acid; $X_3$ is S; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06 E1/I2 deletion/V3S; SEQ ID NO: 236);

(t) SEQ ID NO: 238, wherein $X_1$ is no amino acid; $X_2$ is no amino acid; $X_3$ is E; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3E; SEQ ID NO: 237);

(u) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01 E1/I2 deletion; SEQ ID NO: 53); or (v) SEQ ID NO: 238, wherein $X_1$ is no amino acid; $X_2$ is no amino acid; $X_3$ is V; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02; SEQ ID NO: 50).

In some embodiments, the antibody includes a heavy chain variable domain and a light chain variable domain, wherein the antibody specifically binds gp120, and wherein the antibody is neutralizing, wherein the heavy chain variable domain includes the amino acid sequence of SEQ ID NO: 196 (NIH4546 heavy chain variable domain), further including a glycine to histidine substitution at Kabat position 54 (a G54H substitution), and wherein the light chain variable domain includes a light chain variable domain as described herein, or a known VRC01-like light chain variable domain. In several embodiments, the antibody is not self-reactive, and/or has low self-reactivity. In additional embodiments, the antibody is not immunogenic and/or has low immunogenicity. For example, in some embodiments, the antibody includes a heavy chain variable domain and a light chain variable domain, wherein the antibody specifically binds gp120, and wherein the antibody is neutralizing, wherein the heavy chain variable domain of the antibody includes SEQ ID NO: 196 (NIH4546 heavy chain variable domain), further including a glycine to histidine substitution at Kabat position 54 (a G54H substitution), and the light chain of the antibody includes:

(a) SEQ ID NO: 238, wherein $X_1$ is E; $X_2$ is I; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01 light chain; SEQ ID NO: 9);

(b) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del-V3E; SEQ ID NO: 219);

(c) SEQ ID NO: 238, wherein $X_1$ is no amino acid; $X_2$ is no amino acid; $X_3$ is K; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L V3K light chain; SEQ ID NO: 220);

(d) SEQ ID NO: 238, wherein $X_1$ is no amino acid; $X_2$ is no amino acid; $X_3$ is S; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del V3S light chain; SEQ ID NO: 221);

(e) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is D; $X_{12}$ is V; and $X_{13}$ is I (VRC01L E1/I2del F97D; SEQ ID NO: 222);

(f) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is K; $X_{12}$ is V; and $X_{13}$ is I (VRC01L E1/I2del F97K; SEQ ID NO: 223);

(g) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del F97S; SEQ ID NO: 224);

(h) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del F97H; SEQ ID NO: 225);

(i) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del V3E/F97S; SEQ ID NO: 226);

(j) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del V3E/F97H; SEQ ID NO: 227);

(k) SEQ ID NO: 238, wherein $X_1$ is no amino acid; $X_2$ is no amino acid; $X_3$ is V; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03; SEQ ID NO: 228);

(l) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04; SEQ ID NO: 229);

(m) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05; SEQ ID NO: 230);

(n) SEQ ID NO: 238, wherein $X_1$ is no amino acid; $X_2$ is no amino acid; $X_3$ is V; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06; SEQ ID NO: 231);

(o) SEQ ID NO: 238, wherein $X_1$ is no amino acid; $X_2$ is no amino acid; $X_3$ is S; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02 E1/I2 deletion/V3S; SEQ ID NO: 232);

(p) SEQ ID NO: 238, wherein $X_1$ is no amino acid; $X_2$ is no amino acid; $X_3$ is S; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03 E1/I2 deletion/V3S; SEQ ID NO: 233);

(q) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3S; SEQ ID NO: 234);

(r) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05 E1/I2 deletion/V3S; SEQ ID NO: 235);

(s) SEQ ID NO: 238, wherein $X_1$ is no amino acid; $X_2$ is no amino acid; $X_3$ is S; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06 E1/I2 deletion/V3S; SEQ ID NO: 236);

(t) SEQ ID NO: 238, wherein $X_1$ is no amino acid; $X_2$ is no amino acid; $X_3$ is E; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3E; SEQ ID NO: 237);

(u) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01 E1/I2 deletion; SEQ ID NO: 53); or (v) SEQ ID NO: 238, wherein $X_1$ is no amino acid; $X_2$ is no amino acid; $X_3$ is V; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02; SEQ ID NO: 50).

2. Additional Exemplary Antibodies

In some embodiments, the isolated monoclonal antibody specifically binds gp120, and includes a heavy chain variable domain including amino acids 26-33 (CDR1), 51-58 (CDR2) and/or 97-114 (CDR3) of SEQ ID NO: 1, wherein the antibody specifically binds gp120 of HIV-1, and wherein the antibody is neutralizing. In some embodiments, the isolated monoclonal antibody specifically binds gp120, and includes a heavy chain variable domain including amino acids 26-33 (CDR1), 51-58 (CDR2) and/or 97-114 (CDR3) of SEQ ID NO: 29, wherein the antibody specifically binds gp120 of HIV-1, and wherein the antibody is neutralizing. In additional embodiments, the heavy chain variable domain of the monoclonal antibody includes amino acids 26-33 (CDR1), 51-58 (CDR2) and/or 97-114 (CDR3) of SEQ ID NO: 2, wherein the antibody specifically binds gp120 and wherein the antibody is neutralizing. In other embodiments, the heavy chain variable domain of the monoclonal antibody includes amino acids 26-33 (CDR1), 51-58 (CDR2) and/or 97-114 (CDR3) of SEQ ID NO: 3 and wherein the antibody specifically binds gp120 and wherein the antibody is neutralizing. In further embodiments, the heavy chain variable domain of the monoclonal antibody includes amino acids 26-33 (CDR1), 51-58 (CDR2) and/or 97-114 (CDR3) of SEQ ID NO: 4 and wherein the antibody specifically binds gp120 wherein the antibody is neutralizing.

In some embodiments, the isolated monoclonal antibody includes a heavy chain variable domain including amino acids 26-33 (CDR1), 51-58 (CDR2) and 97-114 (CDR3) of SEQ ID NO: 1, wherein the antibody specifically binds gp120 of HIV-1, and wherein the antibody is neutralizing. In some embodiments, the isolated monoclonal antibody specifically binds gp120, and includes a heavy chain variable domain including amino acids 26-33 (CDR1), 51-58 (CDR2) and/or 97-114 (CDR3) of SEQ ID NO: 29, wherein the antibody specifically binds gp120 of HIV-1, and wherein the antibody is neutralizing. In additional embodiments, the heavy chain variable domain of the monoclonal antibody includes amino acids 26-33 (CDR1), 51-58 (CDR2) and 97-114 (CDR3) of SEQ ID NO: 2, wherein the antibody specifically binds gp120 and wherein the antibody is neutralizing. In other embodiments, the heavy chain variable domain of the monoclonal antibody includes amino acids 26-33 (CDR1), 51-58 (CDR2) and 97-114 (CDR3) of SEQ ID NO: 3 and wherein the antibody specifically binds gp120 and wherein the antibody is neutralizing. In further embodiments, the heavy chain variable domain of the monoclonal antibody includes amino acids 26-33 (CDR1), 51-58 (CDR2) and 97-114 (CDR3) of SEQ ID NO: 4 and wherein the antibody specifically binds gp120 wherein the antibody is neutralizing.

In further embodiments, the isolated monoclonal antibody includes a heavy chain variable domain including amino acids 26-33 (CDR1), 51-58 (CDR2) and/or 97-114 (CDR3) of SEQ ID NO: 30, wherein the antibody specifically binds gp120 of HIV-1, and wherein the antibody is neutralizing. In specific non-limiting examples, the isolated monoclonal antibody includes a heavy chain variable domain including amino acids 26-33 (CDR1), 51-58 (CDR2) and 97-114 (CDR3) of one of SEQ ID NOs: 31-36, wherein the antibody specifically binds gp120 of HIV-1, and wherein the antibody is neutralizing. In several embodiments, the antibody is not self-reactive, and/or has low self-reactivity. In additional embodiments, the antibody is not immunogenic and/or has low immunogenicity.

In yet other embodiments, the isolated monoclonal antibody includes a heavy chain variable domain including amino acids 26-33 (CDR1), 51-58 (CDR2) and 97-114 (CDR3) of SEQ ID NO: 30, wherein the antibody specifically binds gp120 of HIV-1, and wherein the antibody is neutralizing. In specific non-limiting examples, the isolated monoclonal antibody includes a heavy chain variable domain including amino acids 26-33 (CDR1), 51-58 (CDR2) and 97-114 (CDR3) of one of SEQ ID NOs: 31-36, wherein the antibody specifically binds gp120 of HIV-1, and wherein the antibody is neutralizing.

In additional embodiments, the isolated monoclonal antibody includes a heavy chain variable domain including amino acids 26-33 (CDR1), 51-58 (CDR2) and/or 97-114 (CDR3) of SEQ ID NO: 38, wherein the antibody specifically binds gp120 of HIV-1, and wherein the antibody is neutralizing. In specific non-limiting examples, the monoclonal antibody includes a heavy chain variable domain including amino acids 26-33 (CDR1), 51-58 (CDR2) and/or 97-114 (CDR3) of SEQ ID NO: 38, wherein $X_{15}$ is Q; $X_{16}$ is V or I and $X_{17}$ is A or T. In other specific non-limiting examples, the monoclonal antibody includes a heavy chain variable domain including amino acids 26-33 (CDR1), 51-58 (CDR2) and/or 97-114 (CDR3) of SEQ ID NO: 38, wherein $X_{15}$ is Q or R; $X_{16}$ is V and $X_{17}$ is A or T. In more specific non-limiting examples, the monoclonal antibody includes a heavy chain variable domain including amino acids 26-33 (CDR1), 51-58 (CDR2) and/or 97-114 (CDR3) of SEQ ID NO: 38, wherein $X_{15}$ is Q or R; $X_{16}$ is V or I and $X_{17}$ is A. In further specific non-limiting examples, the monoclonal antibody includes a heavy chain variable domain including amino acids 26-33 (CDR1), 51-58 (CDR2) and/or 97-114 (CDR3) of SEQ ID NO: 38, wherein $X_{15}$ is Q; $X_{16}$ is V and $X_{17}$ is A or T. In yet other specific non limiting examples, the monoclonal antibody includes a heavy chain variable domain including amino acids 26-33 (CDR1), 51-58 (CDR2) and/or 97-114 (CDR3) of SEQ ID NO: 38, wherein $X_{15}$ is Q or R; $X_{16}$ is V and $X_{17}$ is A. In different specific non-limiting examples, the monoclonal antibody includes a heavy chain variable domain including amino acids 26-33 (CDR1), 51-58 (CDR2) and/or 97-114 (CDR3) of SEQ ID NO: 38, wherein $X_{15}$ is Q; $X_{16}$ is V or I and $X_{17}$ is A. In additional embodiments, the isolated monoclonal antibody includes a heavy chain variable domain including amino acids 26-33 (CDR1), 51-58 (CDR2) and/or 97-114 (CDR3) of SEQ ID NO: 39, wherein the antibody specifically binds gp120 of HIV-1.

In additional embodiments, the isolated monoclonal antibody includes a heavy chain variable domain including amino acids 26-33 (CDR1), 51-58 (CDR2) and 97-114 (CDR3) of SEQ ID NO: 38, wherein the antibody specifically binds gp120 of HIV-1, and wherein the antibody is neutralizing. In other specific non-limiting examples, the monoclonal antibody includes a heavy chain variable domain including amino acids 26-33 (CDR1), 51-58 (CDR2) and/or 97-114 (CDR3) of SEQ ID NO: 38, wherein $X_{15}$ is Q or R; $X_{16}$ is V and $X_{17}$ is A or T. In more specific non-limiting examples, the monoclonal antibody includes a heavy chain variable domain including amino acids 26-33 (CDR1), 51-58 (CDR2) and 97-114 (CDR3) of SEQ ID NO: 38, wherein $X_{15}$ is Q or R; $X_{16}$ is V or I and $X_{17}$ is A. In further specific non-limiting examples, the monoclonal antibody includes a heavy chain variable domain including amino acids 26-33 (CDR1), 51-58 (CDR2) and 97-114 (CDR3) of SEQ ID NO: 38, wherein $X_{15}$ is Q; $X_{16}$ is V and $X_{17}$ is A or T. In yet other specific non limiting examples, the monoclonal antibody includes a heavy chain variable domain including amino acids 26-33 (CDR1), 51-58 (CDR2) and 97-114 (CDR3) of SEQ ID NO: 38, wherein $X_{15}$ is Q or R; $X_{16}$ is V and $X_{17}$ is A. In different specific non-limiting examples, the monoclonal antibody includes a heavy chain variable domain including amino acids 26-33 (CDR1), 51-58 (CDR2) and 97-114 (CDR3) of SEQ ID NO: 38, wherein $X_{15}$ is Q; $X_{16}$ is V or I and $X_{17}$ is A. In additional embodiments, the isolated monoclonal antibody includes a heavy chain variable domain including amino acids 26-33 (CDR1), 51-58 (CDR2) and 97-114 (CDR3) of SEQ ID NO: 39, wherein the antibody specifically binds gp120 of HIV-1.

In some embodiments, the monoclonal antibody includes a heavy chain variable domain including SEQ ID NO: 1 or SEQ ID NO: 29. Specific, non-limiting examples are antibodies that include a heavy chain variable domain that includes an amino acid sequence set forth as SEQ ID NO: 2, SEQ ID NO: 3 or SEQ ID NO: 4.

In some embodiments, the isolated monoclonal antibody specifically binds gp120, and includes a heavy chain variable domain including amino acids 26-33 (CDR1), 51-58 (CDR2) and/or 97-114 (CDR3) of SEQ ID NO: 23, wherein the antibody specifically binds gp120 of HIV-1, and wherein the antibody is neutralizing. In additional embodiments, the heavy chain variable domain of the monoclonal antibody includes amino acids 26-33 (CDR1), 51-58 (CDR2) and/or 97-114 (CDR3) of SEQ ID NO: 24, wherein the antibody specifically binds gp120 and wherein the antibody is neutralizing. In another embodiment, the heavy chain variable domain of the monoclonal antibody includes amino acids 26-33 (CDR1), 51-58 (CDR2) and/or 97-114 (CDR3) of SEQ ID NO: 25 and wherein the antibody specifically binds gp120 and wherein the antibody is neutralizing. In further embodiments, the heavy chain variable domain of the monoclonal antibody includes amino acids 26-33 (CDR1), 51-58 (CDR2) and/or 97-114 (CDR3) of SEQ ID NO: 26 and wherein the antibody specifically binds gp120 wherein the antibody is neutralizing.

In some embodiments, the isolated monoclonal antibody includes a heavy chain variable domain including amino acids 26-33 (CDR1), 51-58 (CDR2) and 97-114 (CDR3) of SEQ ID NO: 23, wherein the antibody specifically binds gp120 of HIV-1, and wherein the antibody is neutralizing. In additional embodiments, the heavy chain variable domain of the monoclonal antibody includes amino acids 26-33 (CDR1), 51-58 (CDR2) and 97-114 (CDR3) of SEQ ID NO: 24, wherein the antibody specifically binds gp120 and wherein the antibody is neutralizing. In another embodiment, the heavy chain variable domain of the monoclonal antibody includes amino acids 26-33 (CDR1), 51-58 (CDR2) and 97-114 (CDR3) of SEQ ID NO: 25 and wherein the antibody specifically binds gp120 and wherein the antibody is neutralizing. In further embodiments, the heavy chain variable domain of the monoclonal antibody includes amino acids 26-33 (CDR1), 51-58 (CDR2) and 97-114 (CDR3) of SEQ ID NO: 26 and wherein the antibody specifically binds gp120 wherein the antibody is neutralizing.

In some embodiments, the monoclonal antibody includes a heavy chain variable domain including SEQ ID NO: 23. Specific, non-limiting examples are antibodies that include a heavy chain variable domain that includes an amino acid sequence set forth as SEQ ID NO: 24, SEQ ID NO: 25, or SEQ ID NO: 26.

In additional embodiments, the monoclonal antibody includes a heavy chain variable domain including the amino acid sequence set forth as SEQ ID NO: 30. Specific, non-limiting examples are antibodies that include a heavy chain variable domain that includes an amino acid sequence set forth as SEQ ID NO: 31, SEQ ID NO: 32, SEQ ID NO: 33, SEQ ID NO: 34, SEQ ID NO: 35 or SEQ ID NO: 36.

In more embodiments, the isolated monoclonal antibody includes a heavy chain variable domain including the amino acid sequence set forth as SEQ ID NO: 38. In specific non-limiting examples, the monoclonal antibody includes a heavy chain variable domain including the amino acid sequence set forth as SEQ ID NO: 38, wherein $X_{15}$ is Q; $X_{16}$ is V or I and $X_{17}$ is A or T. In other specific non-limiting examples, the monoclonal antibody includes a heavy chain variable domain including the amino acid sequence set forth as SEQ ID NO: 38, wherein $X_{15}$ is Q or R; $X_{16}$ is V and $X_{17}$ is A or T. In more specific non-limiting examples, the monoclonal antibody includes a heavy chain variable domain including the amino acid sequence set forth as SEQ ID NO: 38, wherein $X_{15}$ is Q or R; $X_{16}$ is V or I and $X_{17}$ is A. In further specific non-limiting examples, the monoclonal antibody includes a heavy chain variable domain the amino acid sequence set forth as SEQ ID NO: 38, wherein $X_{15}$ is Q; $X_{16}$ is V and $X_{17}$ is A or T. In yet other specific non limiting examples, the monoclonal antibody includes a heavy chain variable domain including the amino acid sequence set forth as SEQ ID NO: 38, wherein $X_{15}$ is Q or R; $X_{16}$ is V and $X_{17}$ is A. In different specific non-limiting examples, the monoclonal antibody includes a heavy chain variable domain including the amino acid sequence set forth as SEQ ID NO: 38, wherein $X_{15}$ is Q; $X_{16}$ is V or I and $X_{17}$ is A. In additional embodiments, the isolated monoclonal antibody includes a heavy chain variable domain the amino acid sequence set forth as SEQ ID NO: 39.

In additional embodiments, the light chain of the isolated human monoclonal antibody includes amino acids 27-30 (CDR1), 48-50 (CDR2) and/or 87-91 (CDR3) of SEQ ID NO: 6 wherein the antibody specifically binds gp120 and wherein the antibody is neutralizing. In further embodiments, the light chain of the isolated human monoclonal antibody includes amino acids 27-30 (CDR1), 48-50 (CDR2) and/or 87-91 (CDR3) of SEQ ID NO: 7, wherein the antibody specifically binds gp120 and wherein the antibody is neutralizing. In some embodiments, the light chain of the isolated human monoclonal antibody includes amino acids 27-30 (CDR1), 48-50 (CDR2) and/or 87-91 (CDR3) of SEQ ID NO: 8, wherein the antibody specifically binds gp120 and wherein the antibody is neutralizing. In other embodiments, the light chain of the isolated human monoclonal antibody includes amino acids 27-30 (CDR1), 48-50 (CDR2) and/or 87-91 (CDR3) of SEQ ID NO: 9, wherein the antibody specifically binds gp120 and wherein the antibody is neutralizing. In further embodiments, the light chain of the isolated human monoclonal antibody includes amino acids 27-30 (CDR1), 48-50 (CDR2) and/or 87-91 (CDR3) of SEQ ID NO: 27, wherein the antibody specifically binds gp120 and wherein the antibody is neutralizing.

In further embodiments, the light chain of the isolated human monoclonal antibody includes amino acids 27-30 (CDR1), 48-50 (CDR2) and 87-91 (CDR3) of SEQ ID NO: 6 wherein the antibody specifically binds gp120 and wherein the antibody is neutralizing. In further embodiments, the light chain of the isolated human monoclonal antibody includes amino acids 27-30 (CDR1), 48-50 (CDR2) and 87-91 (CDR3) of SEQ ID NO: 7 wherein the antibody specifically binds gp120 and wherein the antibody is neutralizing. In some embodiments, the light chain of the isolated human monoclonal antibody includes amino acids 27-30 (CDR1), 48-50 (CDR2) and 87-91 (CDR3) of SEQ ID NO: 8 wherein the antibody specifically binds gp120 and wherein the antibody is neutralizing. In other embodiments, the light chain of the isolated human monoclonal antibody includes amino acids 27-30 (CDR1), 48-50 (CDR2) and 87-91 (CDR3) of SEQ ID NO: 9 wherein the antibody specifically binds gp120 and wherein the antibody is neutralizing. In further embodiments, the light chain of the isolated human monoclonal antibody includes amino acids 27-30 (CDR1), 48-50 (CDR2) and 87-91 (CDR3) of SEQ ID NO: 27, wherein the antibody specifically binds gp120 and wherein the antibody is neutralizing.

In some embodiments, the monoclonal antibody includes a light chain variable domain including SEQ ID NO: 6. Specific, non-limiting examples are antibodies that include a light chain variable domain that includes an amino acid sequence set forth as SEQ ID NO: 7 or SEQ ID NO: 8. In other embodiments, the monoclonal antibody includes a light chain variable domain including SEQ ID NO: 9. In still other embodiments, the monoclonal antibody includes a light chain variable domain including as SEQ ID NO: 27.

In some embodiments the light chain variable domain of the antibody includes amino acids 27-30 (CDR1), 48-50 (CDR2) and 87-91 (CDR3) of SEQ ID NO: 41. In additional embodiments, the light chain variable domain of the antibody includes SEQ ID NO: 41, wherein $X_1$ is E, $X_2$ is I, $X_3$ is I, $X_4$ is W, $X_5$ is N, $X_6$ is V, and $X_7$ is I [VRC01]. In more embodiments, the light chain variable domain includes SEQ ID NO: 41, wherein $X_1$ is no amino acid, $X_2$ is no amino acid, $X_3$ is I, $X_4$ is W, $X_5$ is N, $X_6$ is V, and $X_7$ is I [VRC01 E1/I2 deletion]. In yet other embodiments, the light chain variable domain includes SEQ ID NO: 41, wherein $X_1$ is no amino acid, $X_2$ is no amino acid, $X_3$ is I, $X_4$ is W, $X_5$ is T, $X_6$ is V, and $X_7$ is I [VRC01 E1/I2 deletion N72T]. In some embodiments, the light chain variable domain includes SEQ ID NO: 41, wherein $X_1$ is E, $X_2$ is I, $X_3$ is T, $X_4$ is 5, $X_5$ is T, $X_6$ is Q, and $X_7$ is N. In additional embodiments, the light chain variable domain includes SEQ ID NO: 41, wherein $X_1$ is no amino acid, $X_2$ is no amino acid, $X_3$ is T, $X_4$ is 5, $X_5$ is T, $X_6$ is Q, and $X_7$ is N. In all of these embodiments, the antibody specifically binds gp120, and wherein the antibody is neutralizing In some embodiments, the isolated monoclonal antibody includes a heavy chain variable domain including amino acids 26-33 (CDR1), 51-58 (CDR2) and/or 97-114 (CDR3) of SEQ ID NO: 40, and a light chain variable domain including amino acids 27-30 (CDR1), 48-50 (CDR2) and/or 87-91 (CDR3) of SEQ ID NO: 41, wherein the antibody specifically binds gp120 of HIV-1, and wherein the antibody is neutralizing. In additional embodiments, the isolated monoclonal antibody includes a heavy chain variable domain including amino acids 26-33 (CDR1), 51-58 (CDR2) and/or 97-114 (CDR3) of SEQ ID NO: 40, wherein $X_1$ is I, $X_2$ is H, $X_3$ is S and $X_4$ is T, and a light chain variable domain including amino acids 27-30 (CDR1), 48-50 (CDR2) and/or 87-91 (CDR3) of SEQ ID NO: 41, wherein the antibody specifically binds gp120 of HIV-1, and wherein the antibody is neutralizing. In other embodiments, the isolated monoclonal antibody includes a heavy chain variable domain including amino acids 26-33 (CDR1), 51-58 (CDR2) and/or 97-114 (CDR3) of SEQ ID NO: 40, wherein $X_1$ is I, $X_2$ is H, $X_3$ is N and $X_4$ is T, and a light chain variable domain including amino acids 27-30 (CDR1), 48-50 (CDR2) and/or 87-91 (CDR3) of SEQ ID NO: 41, wherein the antibody specifically binds gp120 of HIV-1, and wherein the antibody is neutralizing.

In yet other embodiments, the isolated monoclonal antibody includes a heavy chain variable domain including SEQ ID NO: 40, and a light chain variable domain including SEQ ID NO: 41. In some embodiments, the heavy chain variable domain of the antibody includes one of: (a) SEQ ID NO: 40, wherein $X_1$ is I, $X_2$ is H, $X_3$ is S and $X_4$ is T; (b) SEQ ID NO: 40, wherein $X_1$ is I, $X_2$ is H, $X_3$ is N and $X_4$ is T; (c) SEQ ID NO: 40, wherein $X_1$ is V, $X_2$ is H, $X_3$ is S and $X_4$ is A; or (d) SEQ ID NO: 40, wherein $X_1$ is V, $X_2$ is H, $X_3$ is N and $X_4$ is A and the light chain variable domain includes SEQ ID NO: 41. In further embodiments, the heavy chain variable domain of the antibody includes one of: (a) SEQ ID NO: 40, wherein $X_1$ is I, $X_2$ is H, $X_3$ is S and $X_4$ is T; (b) SEQ ID NO: 40, wherein $X_1$ is I, $X_2$ is H, $X_3$ is N and $X_4$ is T; (c) SEQ ID NO: 40, wherein $X_1$ is V, $X_2$ is H, $X_3$ is S and $X_4$ is A; or (d) SEQ ID NO: 40, wherein $X_1$ is V, $X_2$ is H, $X_3$ is N and $X_4$ is V; and the light chain variable domain includes one of (e) SEQ ID NO: 41, wherein $X_1$ is E, $X_2$ is I, $X_3$ is I, $X_4$ is W, $X_5$ is N, $X_6$ is V, and $X_7$ is I [VRC01]; (f) SEQ ID NO: 41, wherein $X_1$ is no amino acid, $X_2$ is no amino acid, $X_3$ is I, $X_4$ is W, $X_5$ is N, $X_6$ is V, and $X_7$ is I [VRC01 E1/I2 deletion]; (g) SEQ ID NO: 41, wherein $X_1$ is no amino acid, $X_2$ is no amino acid, $X_3$ is I, $X_4$ is W, $X_5$ is T, $X_6$ is V, and $X_7$ is I [VRC01 E1/I2 deletion N72T]; (h) SEQ ID NO: 41, wherein $X_1$ is E, $X_2$ is I, $X_3$ is T, $X_4$ is 5, $X_5$ is T, $X_6$ is Q, and $X_7$ is N; or (i) SEQ ID NO: 41, wherein $X_1$ is E, $X_2$ is no amino acid, $X_3$ is T, $X_4$ is 5, $X_5$ is T, $X_6$ is Q, and $X_7$ is N.

In some embodiments, the isolated monoclonal antibody includes a heavy chain variable domain including amino acids 26-33 (CDR1), 51-58 (CDR2) and/or 97-114 (CDR3) of SEQ ID NO: 1, and includes a light chain variable domain including amino acids 27-30 (CDR1), 48-50 (CDR2) and/or 87-91 (CDR3) of SEQ ID NO: 6, wherein the antibody specifically binds gp120 of HIV-1, and wherein the antibody is neutralizing. In further embodiments, the isolated monoclonal antibody includes a heavy chain variable domain including amino acids 26-33 (CDR1), 51-58 (CDR2) and/or 97-114 (CDR3) of SEQ ID NO: 2, and includes a light chain variable domain including amino acids 27-30 (CDR1), 48-50 (CDR2) and/or 87-91 (CDR3) of SEQ ID NO: 9, wherein the antibody specifically binds gp120 of HIV-1, and wherein the antibody is neutralizing. In additional embodiments, the heavy chain variable domain of the monoclonal antibody includes amino acids 26-33 (CDR1), 51-58 (CDR2) and/or 97-114 (CDR3) of SEQ ID NO: 3, and the light chain variable domain and includes a light chain variable domain including amino acids 27-30 (CDR1), 48-50 (CDR2) and/or 87-91 (CDR3) of SEQ ID NO: 7, wherein the antibody specifically binds gp120 and wherein the antibody is neutralizing. In yet other embodiments, the isolated monoclonal antibody includes a heavy chain variable domain including amino acids 26-33 (CDR1), 51-58 (CDR2) and/or 97-114 (CDR3) of SEQ ID NO: 4, and includes a light chain variable domain including amino acids 27-30 (CDR1), 48-50 (CDR2) and/or 87-91 (CDR3) of SEQ ID NO: 8, wherein the antibody specifically binds gp120 of HIV-1, and wherein the antibody is neutralizing.

In additional embodiments, the isolated monoclonal antibody includes a heavy chain variable domain including amino acids 26-33 (CDR1), 51-58 (CDR2) and 97-114 (CDR3) of SEQ ID NO: 1, and includes a light chain variable domain including amino acids 27-30 (CDR1), 48-50 (CDR2) and 87-91 (CDR3) of SEQ ID NO: 6, wherein the antibody specifically binds gp120 of HIV-1, and wherein the antibody is neutralizing. In further embodiments, the isolated monoclonal antibody includes a heavy chain variable domain including amino acids 26-33 (CDR1), 51-58 (CDR2) and 97-114 (CDR3) of SEQ ID NO: 2, and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing. In additional embodiments, the heavy chain variable domain of the monoclonal antibody includes amino acids 26-33 (CDR1), 51-58 (CDR2) and 97-114 (CDR3) of SEQ ID NO: 3, and the light chain variable domain and includes a light chain variable domain including amino acids 27-30 (CDR1), 48-50 (CDR2) and 87-91 (CDR3) of SEQ ID NO: 7, wherein the antibody specifically binds gp120 and wherein the antibody is neutralizing. In yet other embodiments, the isolated monoclonal antibody includes a heavy chain variable domain including amino acids 26-33 (CDR1), 51-58 (CDR2) and 97-114 (CDR3) of SEQ ID NO: 4, and includes a light chain variable domain including amino acids 27-30 (CDR1), 48-50 (CDR2) and 87-91 (CDR3) of SEQ ID NO: 8, wherein the antibody specifically binds gp120 of HIV-1, and wherein the antibody is neutralizing.

In yet other embodiments, the isolated monoclonal antibody includes a heavy chain variable domain including amino acids 26-33 (CDR1), 51-58 (CDR2) and/or 97-114 (CDR3) of SEQ ID NO: 1, and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing. In additional embodiments, the heavy chain variable domain of the monoclonal antibody includes amino acids 26-33 (CDR1), 51-58 (CDR2) and 97-114 (CDR3) of SEQ ID NO: 3, and the light chain variable domain and includes a light chain variable domain including amino acids 27-30 (CDR1), 48-50 (CDR2) and 87-91 (CDR3) of SEQ ID NO: 9, wherein the antibody specifically binds gp120 and wherein the antibody is neutralizing. In yet other embodiments, the isolated monoclonal antibody includes a heavy chain variable domain including amino acids 26-33 (CDR1), 51-58 (CDR2) and 97-114 (CDR3) of SEQ ID NO: 4, and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing.

In yet other embodiments, the isolated monoclonal antibody includes a heavy chain variable domain including amino acids 26-33 (CDR1), 51-58 (CDR2) and/or 97-114 (CDR3) of SEQ ID NO: 30, and includes a light chain variable domain including amino acids 27-30 (CDR1), 48-50 (CDR2) and/or 87-91 (CDR3) of SEQ ID NO: 6, wherein the antibody specifically binds gp120 of HIV-1, and wherein the antibody is neutralizing. In specific non-limiting examples, the isolated monoclonal antibody includes a heavy chain variable domain including amino acids 26-33 (CDR1), 51-58 (CDR2) and 97-114 (CDR3) of SEQ ID NO: 30, and includes a light chain variable domain including amino acids 27-30 (CDR1), 48-50 (CDR2) and 87-91 (CDR3) of SEQ ID NO: 6, wherein the antibody specifically binds gp120 of HIV-1, and wherein the antibody is neutralizing. In additional non-limiting examples, the isolated monoclonal antibody includes a heavy chain variable domain including amino acids 26-33 (CDR1), 51-58 (CDR2) and/or 97-114 (CDR3) of one of SEQ ID NOs: 31-36, and includes a light chain variable domain including amino acids 27-30 (CDR1), 48-50 (CDR2) and/or 87-91 (CDR3) of SEQ ID NO: 6, wherein the antibody specifically binds gp120 of HIV-1, and wherein the antibody is neutralizing. In more non-limiting examples, the isolated monoclonal antibody includes a heavy chain variable domain including amino acids 26-33 (CDR1), 51-58 (CDR2) and 97-114 (CDR3) of one of SEQ ID NOs: 31-36, and includes a light chain variable domain including amino acids 27-30 (CDR1), 48-50 (CDR2) and 87-91 (CDR3) of SEQ ID NO: 6, wherein the antibody specifically binds gp120 of HIV-1, and wherein the antibody is neutralizing. In several embodiments, the antibody is not self-reactive, and/or has low self-reactivity. In additional embodiments, the antibody is not immunogenic and/or has low immunogenicity.

In further embodiments, the isolated monoclonal antibody includes a heavy chain variable domain including amino acids 26-33 (CDR1), 51-58 (CDR2) and/or 97-114 (CDR3) of SEQ ID NO: 30, and includes a light chain variable domain including amino acids 27-30 (CDR1), 48-50 (CDR2) and/or 87-91 (CDR3) of SEQ ID NO: 7, wherein the antibody specifically binds gp120 and wherein the antibody is neutralizing. In specific non-limiting examples, the isolated monoclonal antibody includes a heavy chain variable domain including amino acids 26-33 (CDR1), 51-58 (CDR2) and 97-114 (CDR3) of SEQ ID NO: 30, and includes a light chain variable domain including amino acids 27-30 (CDR1), 48-50 (CDR2) and 87-91 (CDR3) of SEQ ID NO: 7, wherein the antibody specifically binds gp120 and wherein the antibody is neutralizing. In additional non-limiting examples, the isolated monoclonal antibody includes a heavy chain variable domain including amino acids 26-33 (CDR1), 51-58 (CDR2) and/or 97-114 (CDR3) of one of SEQ ID NOs: 31-36, and includes a light chain variable domain including amino acids 27-30 (CDR1), 48-50 (CDR2) and/or 87-91 (CDR3) of SEQ ID NO: 7, wherein the antibody specifically binds gp120 and wherein the antibody is neutralizing. In more non-limiting examples, the isolated monoclonal antibody includes a heavy chain variable domain including amino acids 26-33 (CDR1), 51-58 (CDR2) and 97-114 (CDR3) of one of SEQ ID NOs: 31-36, and includes a light chain variable domain including amino acids 27-30 (CDR1), 48-50 (CDR2) and 87-91 (CDR3) of SEQ ID NO: 7, wherein the antibody specifically binds gp120 and wherein the antibody is neutralizing. In several embodiments, the antibody is not self-reactive, and/or has low self-reactivity. In additional embodiments, the antibody is not immunogenic and/or has low immunogenicity.

In some embodiments, the isolated monoclonal antibody includes a heavy chain variable domain including amino acids 26-33 (CDR1), 51-58 (CDR2) and/or 97-114 (CDR3) of SEQ ID NO: 30, and includes a light chain variable domain including amino acids 27-30 (CDR1), 48-50 (CDR2) and/or 87-91 (CDR3) of SEQ ID NO: 8, wherein the antibody specifically binds gp120 and wherein the antibody is neutralizing. In some non-limiting examples, the isolated monoclonal antibody includes a heavy chain variable domain including amino acids 26-33 (CDR1), 51-58 (CDR2) and 97-114 (CDR3) of SEQ ID NO: 30, and includes a light chain variable domain including amino acids 27-30 (CDR1), 48-50 (CDR2) and 87-91 (CDR3) of SEQ ID NO: 8, wherein the antibody specifically binds gp120 and wherein the antibody is neutralizing. In additional non-limiting examples, the isolated monoclonal antibody includes a heavy chain variable domain including amino acids 26-33 (CDR1), 51-58 (CDR2) and/or 97-114 (CDR3) of one of SEQ ID NOs: 31-36, and includes a light chain variable domain including amino acids 27-30 (CDR1), 48-50 (CDR2) and/or 87-91 (CDR3) of SEQ ID NO: 8, wherein the antibody specifically binds gp120 and wherein the antibody is neutralizing. In more non-limiting examples, the isolated monoclonal antibody includes a heavy chain variable domain including amino acids 26-33 (CDR1), 51-58 (CDR2) and 97-114 (CDR3) of one of SEQ ID NOs: 31-36, and includes a light chain variable domain including amino acids 27-30 (CDR1), 48-50 (CDR2) and 87-91 (CDR3) of SEQ ID NO: 8, wherein the antibody specifically binds gp120 and wherein the antibody is neutralizing. In several embodiments, the antibody is not self-reactive, and/or has low self-reactivity. In additional embodiments, the antibody is not immunogenic and/or has low immunogenicity.

In yet other embodiments, the isolated monoclonal antibody includes a heavy chain variable domain including amino acids 26-33 (CDR1), 51-58 (CDR2) and/or 97-114 (CDR3) of SEQ ID NO: 30, and includes a light chain variable domain including amino acids 27-30 (CDR1), 48-50 (CDR2) and/or 87-91 (CDR3) of SEQ ID NO: 9, wherein the antibody specifically binds gp120 of HIV-1, and wherein the antibody is neutralizing. In some non-limiting examples, the isolated monoclonal antibody includes a heavy chain variable domain including amino acids 26-33 (CDR1), 51-58 (CDR2) and 97-114 (CDR3) of SEQ ID NO: 30, and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing. In specific non-limiting examples, the isolated monoclonal antibody includes a heavy chain variable domain including amino acids 26-33 (CDR1), 51-58 (CDR2) and/or 97-114 (CDR3) of one of SEQ ID NOs: 31-36, and includes a light chain variable domain including amino acids 27-30 (CDR1), 48-50 (CDR2) and/or 87-91 (CDR3) of SEQ ID NO: 9, wherein the antibody specifically binds gp120 of HIV-1, and wherein the antibody is neutralizing. In more non-limiting examples, the isolated monoclonal antibody includes a heavy chain variable domain including amino acids 26-33 (CDR1), 51-58 (CDR2) and 97-114 (CDR3) of one of SEQ ID NOs: 31-36, and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing. In several embodiments, the antibody is not self-reactive, and/or has low self-reactivity. In additional embodiments, the antibody is not immunogenic and/or has low immunogenicity.

In additional embodiments, the isolated monoclonal antibody includes a heavy chain variable domain including amino acids 26-33 (CDR1), 51-58 (CDR2) and/or 97-114 (CDR3) of SEQ ID NO: 30, and includes a light chain variable domain including amino acids 27-30 (CDR1), 48-50 (CDR2) and/or 87-91 (CDR3) of SEQ ID NO: 27, wherein the antibody specifically binds gp120 and wherein the antibody is neutralizing. In some non-limiting examples, the isolated monoclonal antibody includes a heavy chain variable domain including amino acids 26-33 (CDR1), 51-58 (CDR2) and 97-114 (CDR3) of SEQ ID NO: 30, and includes a light chain variable domain including amino acids 27-30 (CDR1), 48-50 (CDR2) and 87-91 (CDR3) of SEQ ID NO: 27, wherein the antibody specifically binds gp120 and wherein the antibody is neutralizing. In additional non-limiting examples, the isolated monoclonal antibody includes a heavy chain variable domain including amino acids 26-33 (CDR1), 51-58 (CDR2) and/or 97-114 (CDR3) of one of SEQ ID NOs: 31-36, and includes a light chain variable domain including amino acids 27-30 (CDR1), 48-50 (CDR2) and/or 87-91 (CDR3) of SEQ ID NO: 27, wherein the antibody specifically binds gp120 and wherein the antibody is neutralizing. In more non-limiting examples, the isolated monoclonal antibody includes a heavy chain variable domain including amino acids 26-33 (CDR1), 51-58 (CDR2) and 97-114 (CDR3) of one of SEQ ID NOs: 31-36, and includes a light chain variable domain including amino acids 27-30 (CDR1), 48-50 (CDR2) and 87-91 (CDR3) of SEQ ID NO: 27, wherein the antibody specifically binds gp120 and wherein the antibody is neutralizing. In several embodiments, the antibody is not self-reactive, and/or has low self-reactivity. In additional embodiments, the antibody is not immunogenic and/or has low immunogenicity.

In several examples, the monoclonal antibody includes a heavy chain variable domain including SEQ ID NO: 30 and a light chain variable domain including SEQ ID NO: 6. In other examples, the monoclonal antibody includes a heavy chain variable domain including SEQ ID NO: 30 and a light chain variable domain including SEQ ID NO: 7. In yet other examples, the monoclonal antibody includes a heavy chain variable domain including SEQ ID NO: 30 and a light chain variable domain including SEQ ID NO: 8. In additional examples, the monoclonal antibody includes a heavy chain variable domain including SEQ ID NO: 30 and a light chain variable domain including SEQ ID NO: 9. In more examples, the monoclonal antibody includes a heavy chain variable domain including SEQ ID NO: 30 and a light chain variable domain including SEQ ID NO: 27.

In further examples, the monoclonal antibody includes a heavy chain variable domain including SEQ ID NO: 31 and a light chain variable domain including SEQ ID NO: 6. In other examples, the monoclonal antibody includes a heavy chain variable domain including SEQ ID NO: 31 and a light chain variable domain including SEQ ID NO: 7. In yet other examples, the monoclonal antibody includes a heavy chain variable domain including SEQ ID NO: 31 and a light chain variable domain including SEQ ID NO: 8. In additional examples, the monoclonal antibody includes a heavy chain variable domain including SEQ ID NO: 31 and a light chain variable domain including SEQ ID NO: 9. In more examples, the monoclonal antibody includes a heavy chain variable domain including SEQ ID NO: 31 and a light chain variable domain including SEQ ID NO: 27.

In more examples, the monoclonal antibody includes a heavy chain variable domain including SEQ ID NO: 32 and a light chain variable domain including SEQ ID NO: 6. In other examples, the monoclonal antibody includes a heavy chain variable domain including SEQ ID NO: 32 and a light chain variable domain including SEQ ID NO: 7. In yet other examples, the monoclonal antibody includes a heavy chain variable domain including SEQ ID NO: 32 and a light chain variable domain including SEQ ID NO: 8. In additional examples, the monoclonal antibody includes a heavy chain variable domain including SEQ ID NO: 32 and a light chain variable domain including SEQ ID NO: 9. In more examples, the monoclonal antibody includes a heavy chain variable domain including SEQ ID NO: 32 and a light chain variable domain including SEQ ID NO: 27.

In yet other examples, the monoclonal antibody includes a heavy chain variable domain including SEQ ID NO: 33 and a light chain variable domain including SEQ ID NO: 6. In other examples, the monoclonal antibody includes a heavy chain variable domain including SEQ ID NO: 33 and a light chain variable domain including SEQ ID NO: 7. In yet other examples, the monoclonal antibody includes a heavy chain variable domain including SEQ ID NO: 33 and a light chain variable domain including SEQ ID NO: 8. In additional examples, the monoclonal antibody includes a heavy chain variable domain including SEQ ID NO: 33 and a light chain variable domain including SEQ ID NO: 9. In more examples, the monoclonal antibody includes a heavy chain variable domain including SEQ ID NO: 33 and a light chain variable domain including SEQ ID NO: 27.

In some examples, the monoclonal antibody includes a heavy chain variable domain including SEQ ID NO: 34 and a light chain variable domain including SEQ ID NO: 6. In other examples, the monoclonal antibody includes a heavy chain variable domain including SEQ ID NO: 34 and a light chain variable domain including SEQ ID NO: 7. In yet other examples, the monoclonal antibody includes a heavy chain variable domain including SEQ ID NO: 34 and a light chain variable domain including SEQ ID NO: 8. In additional examples, the monoclonal antibody includes a heavy chain variable domain including SEQ ID NO: 34 and a light chain variable domain including SEQ ID NO: 9. In more examples, the monoclonal antibody includes a heavy chain variable domain including SEQ ID NO: 34 and a light chain variable domain including SEQ ID NO: 27.

In additional examples, the monoclonal antibody includes a heavy chain variable domain including SEQ ID NO: 35 and a light chain variable domain including SEQ ID NO: 6. In other examples, the monoclonal antibody includes a heavy chain variable domain including SEQ ID NO: 35 and a light chain variable domain including SEQ ID NO: 7. In yet other examples, the monoclonal antibody includes a heavy chain variable domain including SEQ ID NO: 35 and a light chain variable domain including SEQ ID NO: 8. In additional examples, the monoclonal antibody includes a heavy chain variable domain including SEQ ID NO: 35 and a light chain variable domain including SEQ ID NO: 9. In more examples, the monoclonal antibody includes a heavy chain variable domain including SEQ ID NO: 35 and a light chain variable domain including SEQ ID NO: 27.

In further examples, the monoclonal antibody includes a heavy chain variable domain including SEQ ID NO: 36 and a light chain variable domain including SEQ ID NO: 6. In other examples, the monoclonal antibody includes a heavy chain variable domain including SEQ ID NO: 36 and a light chain variable domain including SEQ ID NO: 7. In yet other examples, the monoclonal antibody includes a heavy chain variable domain including SEQ ID NO: 36 and a light chain variable domain including SEQ ID NO: 8. In additional examples, the monoclonal antibody includes a heavy chain variable domain including SEQ ID NO: 36 and a light chain variable domain including SEQ ID NO: 9. In more examples, the monoclonal antibody includes a heavy chain variable domain including SEQ ID NO: 36 and a light chain variable domain including SEQ ID NO: 27.

In yet other embodiments, the isolated monoclonal antibody includes a heavy chain variable domain including amino acids 26-33 (CDR1), 51-58 (CDR2) and/or 97-114 (CDR3) of SEQ ID NO: 38 or SEQ ID NO: 39, and includes a light chain variable domain including amino acids 27-30 (CDR1), 48-50 (CDR2) and/or 87-91 (CDR3) of SEQ ID NO: 6, wherein the antibody specifically binds gp120 of HIV-1, and wherein the antibody is neutralizing. In specific non-limiting examples, the isolated monoclonal antibody includes a heavy chain variable domain including amino acids 26-33 (CDR1), 51-58 (CDR2) and 97-114 (CDR3) of SEQ ID NO: 38 or SEQ ID NO: 39, and includes a light chain variable domain including amino acids 27-30 (CDR1), 48-50 (CDR2) and 87-91 (CDR3) of SEQ ID NO: 6, wherein the antibody specifically binds gp120 of HIV-1, and wherein the antibody is neutralizing. In several embodiments, the antibody is not self-reactive, and/or has low self-reactivity. In additional embodiments, the antibody is not immunogenic and/or has low immunogenicity.

In further embodiments, the isolated monoclonal antibody includes a heavy chain variable domain including amino acids 26-33 (CDR1), 51-58 (CDR2) and/or 97-114 (CDR3) of SEQ ID NO: 38 or SEQ ID NO: 39, and includes a light chain variable domain including amino acids 27-30 (CDR1), 48-50 (CDR2) and/or 87-91 (CDR3) of SEQ ID NO: 7, wherein the antibody specifically binds gp120 and wherein the antibody is neutralizing. In specific non-limiting examples, the isolated monoclonal antibody includes a heavy chain variable domain including amino acids 26-33 (CDR1), 51-58 (CDR2) and 97-114 (CDR3) of SEQ ID NO: 38 or SEQ ID NO: 39, and includes a light chain variable domain including amino acids 27-30 (CDR1), 48-50 (CDR2) and 87-91 (CDR3) of SEQ ID NO: 7, wherein the antibody specifically binds gp120 and wherein the antibody is neutralizing. In several embodiments, the antibody is not self-reactive, and/or has low self-reactivity. In additional embodiments, the antibody is not immunogenic and/or has low immunogenicity.

In some embodiments, the isolated monoclonal antibody includes a heavy chain variable domain including amino acids 26-33 (CDR1), 51-58 (CDR2) and/or 97-114 (CDR3) of SEQ ID NO: 38 or SEQ ID NO: 39, and includes a light chain variable domain including amino acids 27-30 (CDR1), 48-50 (CDR2) and/or 87-91 (CDR3) of SEQ ID NO: 8, wherein the antibody specifically binds gp120 and wherein the antibody is neutralizing. In some non-limiting examples, the isolated monoclonal antibody includes a heavy chain variable domain including amino acids 26-33 (CDR1), 51-58 (CDR2) and 97-114 (CDR3) of SEQ ID NO: 38 or SEQ ID NO: 39, and includes a light chain variable domain including amino acids 27-30 (CDR1), 48-50 (CDR2) and 87-91 (CDR3) of SEQ ID NO: 8, wherein the antibody specifically binds gp120 and wherein the antibody is neutralizing. In several embodiments, the antibody is not self-reactive, and/or has low self-reactivity. In additional embodiments, the antibody is not immunogenic and/or has low immunogenicity. In yet other embodiments, the isolated monoclonal antibody includes a heavy chain variable domain including amino acids 26-33 (CDR1), 51-58 (CDR2) and/or 97-114 (CDR3) of SEQ ID NO: 38 or SEQ ID NO: 39, and includes a light chain variable domain including amino acids 27-30 (CDR1), 48-50 (CDR2) and/or 87-91 (CDR3) of SEQ ID NO: 9, wherein the antibody specifically binds gp120 of HIV-1, and wherein the antibody is neutralizing. In some non-limiting examples, the isolated monoclonal antibody includes a heavy chain variable domain including amino acids 26-33 (CDR1), 51-58 (CDR2) and 97-114 (CDR3) of SEQ ID NO: 38 or SEQ ID NO: 39, and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing. In several embodiments, the antibody is not self-reactive, and/or has low self-reactivity. In additional embodiments, the antibody is not immunogenic and/or has low immunogenicity.

In additional embodiments, the isolated monoclonal antibody includes a heavy chain variable domain including amino acids 26-33 (CDR1), 51-58 (CDR2) and/or 97-114 (CDR3) of SEQ ID NO: 38 or SEQ ID NO: 39, and includes a light chain variable domain including amino acids 27-30 (CDR1), 48-50 (CDR2) and/or 87-91 (CDR3) of SEQ ID NO: 27, wherein the antibody specifically binds gp120 and wherein the antibody is neutralizing. In some non-limiting examples, the isolated monoclonal antibody includes a heavy chain variable domain including amino acids 26-33 (CDR1), 51-58 (CDR2) and 97-114 (CDR3) of SEQ ID NO: 38 or SEQ ID NO: 39, and includes a light chain variable domain including amino acids 27-30 (CDR1), 48-50 (CDR2) and 87-91 (CDR3) of SEQ ID NO: 27, wherein the antibody specifically binds gp120 and wherein the antibody is neutralizing. In several embodiments, the antibody is not self-reactive, and/or has low self-reactivity. In additional embodiments, the antibody is not immunogenic and/or has low immunogenicity.

In several examples, the monoclonal antibody includes a heavy chain variable domain including SEQ ID NO: 38 and a light chain variable domain including SEQ ID NO: 6. In other examples, the monoclonal antibody includes a heavy chain variable domain including SEQ ID NO: 38 and a light chain variable domain including SEQ ID NO: 7. In yet other examples, the monoclonal antibody includes a heavy chain variable domain including SEQ ID NO: 38 and a light chain variable domain including SEQ ID NO: 8. In additional examples, the monoclonal antibody includes a heavy chain variable domain including SEQ ID NO: 38 and a light chain variable domain including SEQ ID NO: 9. In more examples, the monoclonal antibody includes a heavy chain variable domain including SEQ ID NO: 38 and a light chain variable domain including SEQ ID NO: 27.

In further examples, the monoclonal antibody includes a heavy chain variable domain including SEQ ID NO: 39 and a light chain variable domain including SEQ ID NO: 6. In other examples, the monoclonal antibody includes a heavy chain variable domain including SEQ ID NO: 39 and a light chain variable domain including SEQ ID NO: 7. In yet other examples, the monoclonal antibody includes a heavy chain variable domain including SEQ ID NO: 39 and a light chain variable domain including SEQ ID NO: 8. In additional examples, the monoclonal antibody includes a heavy chain variable domain including SEQ ID NO: 39 and a light chain variable domain including SEQ ID NO: 9. In more examples, the monoclonal antibody includes a heavy chain variable domain including SEQ ID NO: 39 and a light chain variable domain including SEQ ID NO: 27.

In some examples, the monoclonal antibody includes a heavy chain variable domain including SEQ ID NO: 1 and a light chain variable domain including SEQ ID NO: 6. In other examples, the monoclonal antibody includes a heavy chain variable domain including SEQ ID NO: 2 and a light chain variable domain including SEQ ID NO: 9. In yet other examples, the monoclonal antibody includes a heavy chain variable domain including SEQ ID NO: 3 and a light chain variable domain including SEQ ID NO: 7. In additional examples, examples, the monoclonal antibody includes a heavy chain variable domain including SEQ ID NO: 4 and a light chain variable domain including SEQ ID NO: 8. In more examples, the monoclonal antibody includes a heavy chain variable domain including SEQ ID NO: 3 and a light chain variable domain including SEQ ID NO: 9. In additional examples, examples, the monoclonal antibody includes a heavy chain variable domain including SEQ ID NO: 4 and a light chain variable domain including SEQ ID NO: 9.

In some embodiments, the isolated monoclonal antibody includes a heavy chain variable domain including amino acids 26-33 (CDR1), 51-58 (CDR2) and/or 97-114 (CDR3) of SEQ ID NO: 23, and includes a light chain variable domain including amino acids 27-30 (CDR1), 48-50 (CDR2) and/or 87-91 (CDR3) of SEQ ID NO: 9, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and/or 97-114 (CDR3) of SEQ ID NO: 24, and includes a light chain variable domain including amino acids 27-30 (CDR1), 48-50 (CDR2) and/or 87-91 (CDR3) of SEQ ID NO: 9, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and/or 97-114 (CDR3) of SEQ ID NO: 25 and includes a light chain variable domain including amino acids 27-30 (CDR1), 48-50 (CDR2) and/or 87-91 (CDR3) of SEQ ID NO: 9, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and/or 97-114 (CDR3) of SEQ ID NO: 26, and includes a light chain variable domain including amino acids 27-30 (CDR1), 48-50 (CDR2) and/or 87-91 (CDR3) of SEQ ID NO: 9, wherein the antibody specifically binds gp120 of HIV-1, and wherein the antibody is neutralizing.

In some embodiments, the isolated monoclonal antibody includes a heavy chain variable domain including amino acids 26-33 (CDR1), 51-58 (CDR2) and/or 97-114 (CDR3) of SEQ ID NO: 23, and includes a light chain variable domain including amino acids 27-30 (CDR1), 48-50 (CDR2) and/or 87-91 (CDR3) of SEQ ID NO: 27, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and/or 97-114 (CDR3) of SEQ ID NO: 24, and includes a light chain variable domain including amino acids 27-30 (CDR1), 48-50 (CDR2) and/or 87-91 (CDR3) of SEQ ID NO: 27, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and/or 97-114 (CDR3) of SEQ ID NO: 25 and includes a light chain variable domain including amino acids 27-30 (CDR1), 48-50 (CDR2) and/or 87-91 (CDR3) of SEQ ID NO: 27, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and/or 97-114 (CDR3) of SEQ ID NO: 26, and includes a light chain variable domain including amino acids 27-30 (CDR1), 48-50 (CDR2) and/or 87-91 (CDR3) of SEQ ID NO: 27, wherein the antibody specifically binds gp120 of HIV-1, and wherein the antibody is neutralizing.

In some embodiments, the isolated monoclonal antibody includes a heavy chain variable domain including amino acids 26-33 (CDR1), 51-58 (CDR2) and 97-114 (CDR3) of SEQ ID NO: 23, and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and 97-114 (CDR3) of SEQ ID NO: 24, and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and 97-114 (CDR3) of SEQ ID NO: 25 and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and 97-114 (CDR3) of SEQ ID NO: 26, and includes a light chain variable domain including amino acids 27-30 (CDR1), 48-50 (CDR2) and 87-91 (CDR3) of SEQ ID NO: 9, wherein the antibody specifically binds gp120 of HIV-1, and wherein the antibody is neutralizing.

In some embodiments, the isolated monoclonal antibody includes a heavy chain variable domain including amino acids 26-33 (CDR1), 51-58 (CDR2) and 97-114 (CDR3) of SEQ ID NO: 23, and includes a light chain variable domain including amino acids 27-30 (CDR1), 48-50 (CDR2) and 87-91 (CDR3) of SEQ ID NO: 27, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and 97-114 (CDR3) of SEQ ID NO: 24, and includes a light chain variable domain including amino acids 27-30 (CDR1), 48-50 (CDR2) and 87-91 (CDR3) of SEQ ID NO: 27, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and 97-114 (CDR3) of SEQ ID NO: 25 and includes a light chain variable domain including amino acids 27-30 (CDR1), 48-50 (CDR2) and 87-91 (CDR3) of SEQ ID NO: 27, wherein the antibody specifically binds gp120 of HIV-1, and wherein the antibody is neutralizing. In some embodiments, the isolated monoclonal antibody includes a heavy chain variable domain including amino acids 26-33 (CDR1), 51-58 (CDR2) and 97-114 (CDR3) of SEQ ID NO: 26, and includes a light chain variable domain including amino acids 27-30 (CDR1), 48-50 (CDR2) and 87-91 (CDR3) of SEQ ID NO: 27, wherein the antibody specifically binds gp120 of HIV-1, and wherein the antibody is neutralizing.

In some examples, the monoclonal antibody includes a heavy chain variable domain including SEQ ID NO: 23 and a light chain variable domain including SEQ ID NO: 9. In some examples, the monoclonal antibody includes a heavy chain variable domain including SEQ ID NO: 24 and a light chain variable domain including SEQ ID NO: 9. In some examples, the monoclonal antibody includes a heavy chain variable domain including SEQ ID NO: 25 and a light chain variable domain including SEQ ID NO: 9. In some examples, the monoclonal antibody includes a heavy chain variable domain including SEQ ID NO: 26 and a light chain variable domain including SEQ ID NO: 9. In some examples, the monoclonal antibody includes a heavy chain variable domain including SEQ ID NO: 23 and a light chain variable domain including SEQ ID NO: 27. In some examples, the monoclonal antibody includes a heavy chain variable domain including SEQ ID NO: 24 and a light chain variable domain including SEQ ID NO: 27. In some examples, the monoclonal antibody includes a heavy chain variable domain including SEQ ID NO: 25 and a light chain variable domain including SEQ ID NO: 27. In some examples, the monoclonal antibody includes a heavy chain variable domain including SEQ ID NO: 26 and a light chain variable domain including SEQ ID NO: 27.

In several embodiments, the monoclonal antibody includes the HCDR1, HCDR2 and/or HCDR3 or the LCDR1, LCDR2 and/or LCDR3 of one of the monoclonal antibody heavy or light chains encoded by one of the nucleic acid molecules listed in Table 2 or Table 3. In several embodiments, the monoclonal antibody includes the HCDR1, HCDR2 and HCDR3 or the LCDR1, LCDR2 and LCDR3 of one of the monoclonal antibody heavy or light chains encoded by one of the nucleic acid molecules listed in Table 2 or Table 3. In additional embodiments, the monoclonal antibody includes a heavy chain variable domain or a light chain variable domain of one of the heavy or light chains encoded by one of the nucleic acid molecules listed in Table 2 or Table 3. In further embodiments, the monoclonal antibody includes a heavy chain or a light chain of one of the heavy or light chains encoded by one of the nucleic acid molecules listed in Table 2 or Table 3.

3. Additional Description of Monoclonal Antibodies

In some embodiments, the heavy chain of the antibody includes at least 1 (such as at least 2, at least 3, at least 4, at least 5, at least 6, at least 7, at least 8, at least 9, at least 10, at least 11, at least 12, or at least 13) amino acid substitutions compared to the amino acid sequence set forth as SEQ ID NO: 5 (VRC01 heavy chain variable domain). In some embodiments, the light chain of the antibody includes at least 1 (such as at least 2, at least 3, at least 4, at least 5, at least 6, at least 7, at least 8, at least 9, at least 10, at least 11, at least 12, or at least 13) amino acid substitutions compared to the amino acid sequence set forth as SEQ ID NO: 9 (VRC01 light chain variable domain). In some embodiments, the heavy chain of the antibody includes at least 1 (such as at least 2, at least 3, at least 4, at least 5, at least 6, at least 7, at least 8, at least 9, at least 10, at least 11, at least 12, or at least 13) amino acid substitutions compared to the amino acid sequence set forth as SEQ ID NO: 2 (VRC07 heavy chain variable domain).

In some examples, the disclosed monoclonal antibodies have a high affinity for gp120, such as a $K_D$ of <3 nM for the antigenic epitope of gp120. In some embodiments, the VRC07 or variants of VRC07 compete with CD4 for binding to gp120.

Those of skill in the art will understand that a set of structure coordinates for the antibody or portions thereof in complex with gp120 or a portion thereof, is a relative set of points that define a shape in three dimensions. Thus, it is possible that an entirely different set of coordinates could define a similar or identical shape. Moreover, slight variations in the individual coordinates will have little effect on overall shape. The variations in coordinates discussed above may be generated because of mathematical manipulations of the structure coordinates.

In several embodiments, the antibody is not self-reactive, and/or has low self-reactivity. In additional embodiments, the antibody is not immunogenic and/or has low immunogenicity. In several embodiments, the disclosed monoclonal antibodies specifically bind to the CD4 binding site on gp120 with an affinity greater than that of VRC01, but are less immunogenic than VRC01 when administered to a subject. In additional embodiments, the disclosed monoclonal antibodies specifically bind to the CD4 binding site on gp120 with an affinity greater than that of VRC01, but are less self-reactive than VRC01.

In some non-limiting examples, a disclosed antibody that is not self-reactive, or has low self reactivity, completes competes poorly with an equal molar or less amount of a control antibody that is known to bind to self antigens. For example, the antibody can elicit about 50% or less inhibition, such as about 40%, 30%, 20% or 10% inhibition, of control antibody binding to anti-nuclear antigen and/or to cardiolipin. In additional non-limiting examples, the antibody has a five-fold or less, such as about six-fold, seven-fold, eight fold, nine-fold, or ten-fold less affinity for cardiolipin and/or nuclear antigen as compared to a control, such as a standard value or the affinity of the control antibody to cardiolipin and/or nuclear antigen, respectively.

In several embodiments, to optimize in vivo half-life, an LS mutation can be added to the FcRn receptor binding region of an antibody. This mutation has no effect on neutralization breadth or potency, but increases the half-life of the antibody by 2- to 3-fold in both humanized mice and non-human primates. Additional the LS mutation to a monoclonal antibody is known to the person of skill in the art (see, e.g., Zalevsky, et al., *Nature Biotechnology*, 28:157-159, 2010).

The monoclonal antibodies disclosed herein can be of any isotype. The monoclonal antibody can be, for example, an IgM or an IgG antibody, such as $IgG_1$ or an $IgG_2$. The class of an antibody that specifically binds gp120 can be switched with another. In one aspect, a nucleic acid molecule encoding $V_L$ or $V_H$ is isolated using methods well-known in the art, such that it does not include any nucleic acid sequences encoding the constant region of the light or heavy chain, respectively.

The nucleic acid molecule encoding $V_L$ or $V_H$ is then operatively linked to a nucleic acid sequence encoding a $C_L$ or $C_H$ from a different class of immunoglobulin molecule. This can be achieved using a vector or nucleic acid molecule that includes a $C_L$ or $C_H$ chain, as known in the art. For example, an antibody that specifically binds gp120 that was originally IgM may be class switched to an IgG. Class switching can be used to convert one IgG subclass to another, such as from $IgG_1$ to $IgG_2$.

In some examples, the disclosed antibodies are oligomers of antibodies, such as dimers trimers, tetramers, pentamers, hexamers, septamers, octomers and so on. In some examples, the antibodies are pentamers. The antibodies can also be included in a bi-specific antibody.

Antibody fragments of the antibodies disclosed herein are provided, which include a heavy chain and light chain variable domain and specifically bind gp120. These antibody fragments retain the ability to selectively bind with the antigen and are "antigen-binding" fragments. These fragments include, but are not limited to:

(1) Fab, the fragment which contains a monovalent antigen-binding fragment of an antibody molecule, can be produced by digestion of whole antibody with the enzyme papain to yield an intact light chain and a portion of one heavy chain;

(2) Fab', the fragment of an antibody molecule can be obtained by treating whole antibody with pepsin, followed by reduction, to yield an intact light chain and a portion of the heavy chain; two Fab' fragments are obtained per antibody molecule;

(3) (Fab')$_2$, the fragment of the antibody that can be obtained by treating whole antibody with the enzyme pepsin without subsequent reduction; F(ab')$_2$ is a dimer of two Fab' fragments held together by two disulfide bonds;

(4) Fv, a genetically engineered fragment containing the variable domain of the light chain and the variable domain of the heavy chain expressed as two chains; and (5) Single chain antibody (such as scFv), defined as a genetically engineered molecule containing the variable domain of the light chain, the variable domain of the heavy chain, linked by a suitable polypeptide linker as a genetically fused single chain molecule.

(6) A dimer of a single chain antibody (scFV$_2$), defined as a dimer of a scFV. This has also been termed a "miniantibody."

Methods of making these fragments are known in the art (see for example, Harlow and Lane, *Antibodies: A Laboratory Manual*, Cold Spring Harbor Laboratory, New York, 1988). In several examples, the variable domain included in the antibody is the variable domain of m912.

In a further group of embodiments, the antibodies are Fv antibodies, which are typically about 25 kDa and contain a complete antigen-binding site with three CDRs per each heavy chain and each light chain. To produce these antibodies, the V$_H$ and the V$_L$ can be expressed from two individual nucleic acid constructs in a host cell. In particular examples, the V$_H$ amino acid sequence includes the CDRs from one of SEQ ID NOs: 1-4, 23-26, 30-36, 38-40, 199-201, 203-207, 216-218, or 258-260. In other examples, the V$_L$ amino acid sequence includes the CDRs from SEQ ID NOs: 6-9 or 27, 41-44, 50-55, 209-215, or 219-257. In additional examples, the V$_H$ amino acid sequence includes the amino acid sequence set forth as one of SEQ ID NOs: 1-4, 23-26, 30-36, 38-40, 199-201, 203-207, 216-218, or 258-260. In other examples, the V$_L$ amino acid sequence includes the amino acid sequence set forth as one of SEQ ID NOs: 6-9 or 27, 41-44, 50-55, 209-215, or 219-257.

If the V$_H$ and the V$_L$ are expressed non-contiguously, the chains of the Fv antibody are typically held together by noncovalent interactions. However, these chains tend to dissociate upon dilution, so methods have been developed to crosslink the chains through glutaraldehyde, intermolecular disulfides, or a peptide linker. Thus, in one example, the Fv can be a disulfide stabilized Fv (dsFv), wherein the heavy chain variable domain and the light chain variable domain are chemically linked by disulfide bonds.

In an additional example, the Fv fragments include V$_H$ and V$_L$ chains connected by a peptide linker. These single-chain antigen binding proteins (scFv) are prepared by constructing a structural gene including DNA sequences encoding the V$_H$ and V$_L$ domains connected by an oligonucleotide. The structural gene is inserted into an expression vector, which is subsequently introduced into a host cell such as *E. coli*. The recombinant host cells synthesize a single polypeptide chain with a linker peptide bridging the two V domains. Methods for producing scFvs are known in the art (see Whitlow et al., *Methods: a Companion to Methods in Enzymology*, Vol. 2, page 97, 1991; Bird et al., *Science* 242:423, 1988; U.S. Pat. No. 4,946,778; Pack et al., *Bio/Technology* 11:1271, 1993; and Sandhu, supra). Dimers of a single chain antibody (scFV$_2$), are also contemplated.

Antibody fragments can be prepared by proteolytic hydrolysis of the antibody or by expression in *E. coli* of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')$_2$. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly (see U.S. Pat. No. 4,036,945 and U.S. Pat. No. 4,331,647, and references contained therein; Nisonhoff et al., *Arch. Biochem. Biophys.* 89:230, 1960;

Porter, *Biochem. J.* 73:119, 1959; Edelman et al., *Methods in Enzymology*, Vol. 1, page 422, Academic Press, 1967; and Coligan et al. at sections 2.8.1-2.8.10 and 2.10.1-2.10.4).

Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

One of skill will realize that conservative variants of the antibodies can be produced. Such conservative variants employed in antibody fragments, such as dsFv fragments or in scFv fragments, will retain critical amino acid residues necessary for correct folding and stabilizing between the V$_H$ and the V$_L$ regions, and will retain the charge characteristics of the residues in order to preserve the low pI and low toxicity of the molecules. Amino acid substitutions (such as at most one, at most two, at most three, at most four, or at most five amino acid substitutions) can be made in the V$_H$ and the V$_L$ regions to increase yield. In particular examples, the V$_H$ sequence is SEQ ID NOs: 1-4, 23-26, 30-36, 38-40, 199-201, 203-207, 216-218, or 258-260. In other examples, the V$_L$ sequence is SEQ ID NOs: 6-9 or 27, 41-44, 50-55, 209-215, or 219-257. Conservative amino acid substitution tables providing functionally similar amino acids are well known to one of ordinary skill in the art. The following six groups are examples of amino acids that are considered to be conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

The antibodies or antibody fragments disclosed herein can be derivatized or linked to another molecule (such as another peptide or protein). In general, the antibody or portion thereof is derivatized such that the binding to gp120 is not affected adversely by the derivatization or labeling. For example, the antibody can be functionally linked (by chemical coupling, genetic fusion, noncovalent association or otherwise) to one or more other molecular entities, such as another antibody (for example, a bispecific antibody or a diabody), a detection agent, a pharmaceutical agent, and/or a protein or peptide that can mediate associate of the antibody or antibody portion with another molecule (such as a streptavidin core region or a polyhistidine tag).

One type of derivatized antibody is produced by cross-linking two or more antibodies (of the same type or of different types, such as to create bispecific antibodies). Suitable crosslinkers include those that are heterobifunctional, having two distinctly reactive groups separated by an appropriate spacer (such as m-maleimidobenzoyl-N-hydroxysuccinimide ester) or homobifunctional (such as disuccinimidyl suberate). Such linkers are available from Pierce Chemical Company (Rockford, Ill.).

An antibody that specifically binds gp120 can be labeled with a detectable moiety. Useful detection agents include fluorescent compounds, including fluorescein, fluorescein isothiocyanate, rhodamine, 5-dimethylamine-1-napthalene-sulfonyl chloride, phycoerythrin, lanthanide phosphors and the like. Bioluminescent markers are also of use, such as luciferase, Green fluorescent protein, Yellow fluorescent protein. An antibody can also be labeled with enzymes that are useful for detection, such as horseradish peroxidase, β-galactosidase, luciferase, alkaline phosphatase, glucose oxidase and the like. When an antibody is labeled with a detectable enzyme, it can be detected by adding additional reagents that the enzyme uses to produce a reaction product that can be discerned. For example, when the agent horseradish peroxidase is present the addition of hydrogen peroxide and diaminobenzidine leads to a colored reaction product, which is visually detectable. An antibody may also be labeled with biotin, and detected through indirect measurement of avidin or streptavidin binding. It should be noted that the avidin itself can be labeled with an enzyme or a fluorescent label.

An antibody may be labeled with a magnetic agent, such as gadolinium. Antibodies can also be labeled with lanthanides (such as europium and dysprosium), and manganese. Paramagnetic particles such as superparamagnetic iron oxide are also of use as labels. An antibody may also be labeled with a predetermined polypeptide epitopes recognized by a secondary reporter (such as leucine zipper pair sequences, binding sites for secondary antibodies, metal binding domains, epitope tags). In some embodiments, labels are attached by spacer arms of various lengths to reduce potential steric hindrance.

An antibody can also be labeled with a radiolabeled amino acid. The radiolabel may be used for both diagnostic and therapeutic purposes. Examples of labels for polypeptides include, but are not limited to, the following radioisotopes or radionucleotides: $^{3}$H, $^{14}$C, $^{15}$N, $^{35}$S, $^{90}$Y, $^{99}$Tc, $^{111}$In, $^{125}$I, $^{131}$I.

An antibody can also be derivatized with a chemical group such as polyethylene glycol (PEG), a methyl or ethyl group, or a carbohydrate group. These groups may be useful to improve the biological characteristics of the antibody, such as to increase serum half-life or to increase tissue binding.

Means of detecting such labels are well known to those of skill in the art. Thus, for example, radiolabels may be detected using photographic film or scintillation counters, fluorescent markers may be detected using a photodetector to detect emitted illumination. Enzymatic labels are typically detected by providing the enzyme with a substrate and detecting the reaction product produced by the action of the enzyme on the substrate, and colorimetric labels are detected by simply visualizing the colored label.

B. Polynucleotides and Expression

Nucleic acid molecules (also referred to as polynucleotides) encoding the polypeptides provided herein (including, but not limited to antibodies) can readily be produced by one of skill in the art. For example, these nucleic acids can be produced using the amino acid sequences provided herein (such as the CDR sequences, heavy chain and light chain sequences), sequences available in the art (such as framework sequences), and the genetic code.

Exemplary $V_H$ nucleic acid sequences are set forth as SEQ ID NOs: 10-13, 37, 57-101, 103, 105, 107-140, 145-156, 161-164, and 177-194, and include degenerate variants; exemplary $V_L$ nucleic acid sequences are set forth as SEQ ID NOs: 14-16, 141-144, 157-160, and 165-176, and include degenerate variants thereof. One of skill in the art can readily use the genetic code to construct a variety of functionally equivalent nucleic acids, such as nucleic acids which differ in sequence but which encode the same antibody sequence, or encode a conjugate or fusion protein including the $V_L$ and/or $V_H$ nucleic acid sequence.

Nucleic acid sequences encoding the antibodies that specifically bind gp120 can be prepared by any suitable method including, for example, cloning of appropriate sequences or by direct chemical synthesis by methods such as the phosphotriester method of Narang et al., *Meth. Enzymol.* 68:90-99, 1979; the phosphodiester method of Brown et al., *Meth. Enzymol.* 68:109-151, 1979; the diethylphosphoramidite method of Beaucage et al., *Tetra. Lett.* 22:1859-1862, 1981; the solid phase phosphoramidite triester method described by Beaucage & Caruthers, *Tetra. Letts.* 22(20):1859-1862, 1981, for example, using an automated synthesizer as described in, for example, Needham-VanDevanter et al., *Nucl. Acids Res.* 12:6159-6168, 1984; and, the solid support method of U.S. Pat. No. 4,458,066. Chemical synthesis produces a single stranded oligonucleotide. This can be converted into double stranded DNA by hybridization with a complementary sequence or by polymerization with a DNA polymerase using the single strand as a template. One of skill would recognize that while chemical synthesis of DNA is generally limited to sequences of about 100 bases, longer sequences may be obtained by the ligation of shorter sequences.

Exemplary nucleic acids can be prepared by cloning techniques. Examples of appropriate cloning and sequencing techniques, and instructions sufficient to direct persons of skill through many cloning exercises are found in Sambrook et al., supra, Berger and Kimmel (eds.), supra, and Ausubel, supra. Product information from manufacturers of biological reagents and experimental equipment also provide useful information. Such manufacturers include the SIGMA™ Chemical Company (Saint Louis, Mo.), R&D Systems™ (Minneapolis, Minn.), Pharmacia Amersham (Piscataway, N.J.), CLONTECH™ Laboratories, Inc. (Palo Alto, Calif.), Chem Genes Corp., Aldrich Chemical Company (Milwaukee, Wis.), Glen Research, Inc., GIBCO™ BRL Life Technologies, Inc. (Gaithersburg, Md.), Fluka Chemica-Biochemika Analytika (Fluka Chemie AG, Buchs, Switzerland), INVITROGEN™ (Carlsbad, Calif.), and Applied Biosystems (Foster City, Calif.), as well as many other commercial sources known to one of skill.

Nucleic acids can also be prepared by amplification methods. Amplification methods include polymerase chain reaction (PCR), the ligase chain reaction (LCR), the transcription-based amplification system (TAS), the self-sustained sequence replication system (3SR). A wide variety of cloning methods, host cells, and in vitro amplification methodologies are well known to persons of skill.

Any of the nucleic acids encoding any of the antibodies, $V_H$ and/or $V_L$, disclosed herein (or fragment thereof) can be expressed in a recombinantly engineered cell such as bacteria, plant, yeast, insect and mammalian cells. These antibodies can be expressed as individual $V_H$ and/or $V_L$ chain, or can be expressed as a fusion protein. An immunoadhesin can also be expressed. Thus, in some examples, nucleic acids encoding a $V_H$ and $V_L$, and immunoadhesin are provided. The nucleic acid sequences can optionally encode a leader sequence.

To create a single chain antibody, (scFv) the $V_H$- and $V_L$-encoding DNA fragments are operatively linked to another fragment encoding a flexible linker, e.g., encoding the amino acid sequence (Gly$_4$-Ser)$_3$ (SEQ ID NO: 48), such that the $V_H$ and $V_L$ sequences can be expressed as a contiguous single-chain protein, with the $V_L$ and $V_H$ domains joined by the flexible linker (see, e.g., Bird et al., Science 242:423-426, 1988; Huston et al., Proc. Natl. Acad. Sci. USA 85:5879-5883, 1988; McCafferty et al., Nature 348: 552-554, 1990). Optionally, a cleavage site can be included in a linker, such as a furin cleavage site.

The nucleic acid encoding the $V_H$ and/or the $V_L$ optionally can encode an Fc domain (immunoadhesin). The Fc domain can be an IgA, IgM or IgG Fc domain. The Fc domain can be an optimized Fc domain, as described in U.S. Published Patent Application No. 20100/093979, incorporated herein by reference. In one example, the immunoadhesin is an IgG$_1$ Fc.

The single chain antibody may be monovalent, if only a single V$_H$ and V$_L$ are used, bivalent, if two V$_H$ and V$_L$ are used, or polyvalent, if more than two V$_H$ and V$_L$ are used. Bispecific or polyvalent antibodies may be generated that bind specifically to gp120 and another antigen, such as, but not limited to gp41, or that bind two different gp120 epitopes. The encoded V$_H$ and V$_L$ optionally can include a furin cleavage site between the V$_H$ and V$_L$ domains.

It is expected that those of skill in the art are knowledgeable in the numerous expression systems available for expression of proteins including *E. coli*, other bacterial hosts, yeast, and various higher eukaryotic cells such as the COS, CHO, HeLa and myeloma cell lines.

The host cell can be a gram positive bacteria including, but not limited to, *Bacillus, Streptococcus, Streptomyces, Staphylococcus, Enterococcus, Lactobacillus, Lactococcus, Clostridium, Geobacillus*, and *Oceanobacillus*. Methods for expressing protein in gram positive bacteria, such as *Lactobaccillus* are well known in the art, see for example, U.S. Published Patent Application No. 20100/080774. Expression vectors for *lactobacillus* are described, for example in U.S. Pat. No. 6,100,388, and U.S. Pat. No. 5,728,571. Leader sequences can be included for expression in *Lactobacillus*. Gram negative bacteria include, but not limited to, *E. coli, Pseudomonas, Salmonella, Campylobacter, Helicobacter, Flavobacterium, Fusobacterium, Ilyobacter, Neisseria*, and *Ureaplasma*.

One or more DNA sequences encoding the antibody or fragment thereof can be expressed in vitro by DNA transfer into a suitable host cell. The cell may be prokaryotic or eukaryotic. The term also includes any progeny of the subject host cell. It is understood that all progeny may not be identical to the parental cell since there may be mutations that occur during replication. Methods of stable transfer, meaning that the foreign DNA is continuously maintained in the host, are known in the art. Hybridomas expressing the antibodies of interest are also encompassed by this disclosure.

The expression of nucleic acids encoding the isolated proteins described herein can be achieved by operably linking the DNA or cDNA to a promoter (which is either constitutive or inducible), followed by incorporation into an expression cassette. The promoter can be any promoter of interest, including a cytomegalovirus promoter and a human T cell lymphotrophic virus promoter (HTLV)-1. Optionally, an enhancer, such as a cytomegalovirus enhancer, is included in the construct. The cassettes can be suitable for replication and integration in either prokaryotes or eukaryotes. Typical expression cassettes contain specific sequences useful for regulation of the expression of the DNA encoding the protein. For example, the expression cassettes can include appropriate promoters, enhancers, transcription and translation terminators, initiation sequences, a start codon (i.e., ATG) in front of a protein-encoding gene, splicing signal for introns, sequences for the maintenance of the correct reading frame of that gene to permit proper translation of mRNA, and stop codons. The vector can encode a selectable marker, such as a marker encoding drug resistance (for example, ampicillin or tetracycline resistance).

To obtain high level expression of a cloned gene, it is desirable to construct expression cassettes which contain, at the minimum, a strong promoter to direct transcription, a ribosome binding site for translational initiation (internal ribosomal binding sequences), and a transcription/translation terminator. For *E. coli*, this includes a promoter such as the T7, trp, lac, or lambda promoters, a ribosome binding site, and preferably a transcription termination signal. For eukaryotic cells, the control sequences can include a promoter and/or an enhancer derived from, for example, an immunoglobulin gene, HTLV, SV40 or cytomegalovirus, and a polyadenylation sequence, and can further include splice donor and/or acceptor sequences (for example, CMV and/or HTLV splice acceptor and donor sequences). The cassettes can be transferred into the chosen host cell by well-known methods such as transformation or electroporation for *E. coli* and calcium phosphate treatment, electroporation or lipofection for mammalian cells. Cells transformed by the cassettes can be selected by resistance to antibiotics conferred by genes contained in the cassettes, such as the amp, gpt, neo and hyg genes.

When the host is a eukaryote, such methods of transfection of DNA as calcium phosphate coprecipitates, conventional mechanical procedures such as microinjection, electroporation, insertion of a plasmid encased in liposomes, or virus vectors may be used. Eukaryotic cells can also be cotransformed with polynucleotide sequences encoding the antibody, labeled antibody, or functional fragment thereof, and a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, *Eukaryotic Viral Vectors*, Cold Spring Harbor Laboratory, Gluzman ed., 1982). One of skill in the art can readily use an expression systems such as plasmids and vectors of use in producing proteins in cells including higher eukaryotic cells such as the COS, CHO, HeLa and myeloma cell lines.

Modifications can be made to a nucleic acid encoding a polypeptide described herein without diminishing its biological activity. Some modifications can be made to facilitate the cloning, expression, or incorporation of the targeting molecule into a fusion protein. Such modifications are well known to those of skill in the art and include, for example, termination codons, a methionine added at the amino terminus to provide an initiation, site, additional amino acids placed on either terminus to create conveniently located restriction sites, or additional amino acids (such as poly His) to aid in purification steps. In addition to recombinant methods, the immunoconjugates, effector moieties, and antibodies of the present disclosure can also be constructed in whole or in part using standard peptide synthesis well known in the art.

Once expressed, the recombinant immunoconjugates, antibodies, and/or effector molecules can be purified according to standard procedures of the art, including ammonium sulfate precipitation, affinity columns, column chromatography, and the like (see, generally, R. Scopes, PROTEIN PURIFICATION, Springer-Verlag, N.Y., 1982). The antibodies, immunoconjugates and effector molecules need not be 100% pure. Once purified, partially or to homogeneity as desired, if to be used therapeutically, the polypeptides should be substantially free of endotoxin.

Methods for expression of antibodies and/or refolding to an appropriate active form, including single chain antibodies, from bacteria such as *E. coli* have been described and are well-known and are applicable to the antibodies disclosed herein. See, Buchner et al., *Anal. Biochem.* 205:263-270, 1992; Pluckthun, *Biotechnology* 9:545, 1991; Huse et al., *Science* 246:1275, 1989 and Ward et al., *Nature* 341:544, 1989.

Often, functional heterologous proteins from *E. coli* or other bacteria are isolated from inclusion bodies and require solubilization using strong denaturants, and subsequent refolding. During the solubilization step, as is well known in the art, a reducing agent must be present to separate disulfide bonds. An exemplary buffer with a reducing agent is: 0.1 M Tris pH 8, 6 M guanidine, 2 mM EDTA, 0.3 M DTE (dithioerythritol). Reoxidation of the disulfide bonds can occur in the presence of low molecular weight thiol reagents in reduced and oxidized form, as described in Saxena et al., *Biochemistry* 9: 5015-5021, 1970, and especially as described by Buchner et al., supra.

Renaturation is typically accomplished by dilution (for example, 100-fold) of the denatured and reduced protein into refolding buffer. An exemplary buffer is 0.1 M Tris, pH 8.0, 0.5 M L-arginine, 8 mM oxidized glutathione (GSSG), and 2 mM EDTA.

As a modification to the two chain antibody purification protocol, the heavy and light chain regions are separately solubilized and reduced and then combined in the refolding solution. An exemplary yield is obtained when these two proteins are mixed in a molar ratio such that a 5-fold molar excess of one protein over the other is not exceeded. Excess oxidized glutathione or other oxidizing low molecular weight compounds can be added to the refolding solution after the redox-shuffling is completed.

In addition to recombinant methods, the antibodies, labeled antibodies and functional fragments thereof that are disclosed herein can also be constructed in whole or in part using standard peptide synthesis. Solid phase synthesis of the polypeptides of less than about 50 amino acids in length can be accomplished by attaching the C-terminal amino acid of the sequence to an insoluble support followed by sequential addition of the remaining amino acids in the sequence. Techniques for solid phase synthesis are described by Barany & Merrifield, *The Peptides: Analysis, Synthesis, Biology. Vol. 2: Special Methods in Peptide Synthesis, Part A*. pp. 3-284; Merrifield et al., *J. Am. Chem. Soc.* 85:2149-2156, 1963, and Stewart et al., *Solid Phase Peptide Synthesis*, 2nd ed., Pierce Chem. Co., Rockford, Ill., 1984. Proteins of greater length may be synthesized by condensation of the amino and carboxyl termini of shorter fragments. Methods of forming peptide bonds by activation of a carboxyl terminal end (such as by the use of the coupling reagent N,N'-dicylohexylcarbodimide) are well known in the art.

B. Compositions and Therapeutic Methods

Methods are disclosed herein for the prevention or treatment of an HIV infection, such as an HIV-1 infection. Prevention can include inhibition of infection with HIV-1. The methods include contacting a cell with a therapeutically effective amount of the human monoclonal antibodies or antigen binding fragment thereof disclosed herein that specifically binds gp120, or an nucleic acid encoding such antibodies or antigen binding fragments. The method can also include administering to a subject a therapeutically effective amount of the human monoclonal antibodies or antigen binding fragments to a subject, or an nucleic acid encoding such antibodies or antigen binding fragments thereof. In some examples, the antibodies, or an antigen binding fragment or a nucleic acid encoding such antibodies or antigen binding fragments, can be used pre-exposure (for example, to prevent or inhibit HIV infection). In some examples, the antibodies, or an antigen binding fragment or an nucleic acid encoding such antibodies or antigen binding thereof, can be used in post-exposure prophylaxis. In some examples, antibodies or antigen binding fragment or an nucleic acid encoding such antibodies or antigen binding fragment, can be used to eliminate or reduce the viral reservoir of HIV in a subject. For example a therapeutically effective amount of an antibody or antigen binding fragment or an nucleic acid encoding such antibodies or antibody binding fragments can be administered to a subject being treated with anti-viral therapy. In some examples the antibodies, or an antibody binding fragment is modified such that it is directly cytotoxic to infected cells, or uses natural defenses such as complement, antibody dependent cellular cytotoxicity (ADCC), or phagocytosis by macrophages.

Methods to assay for neutralization activity include, but are not limited to, a single-cycle infection assay as described in Martin et al. (2003) *Nature Biotechnology* 21:71-76. In this assay, the level of viral activity is measured via a selectable marker whose activity is reflective of the amount of viable virus in the sample, and the IC50 is determined. In other assays, acute infection can be monitored in the PM1 cell line or in primary cells (normal PBMC). In this assay, the level of viral activity can be monitored by determining the p24 concentrations using ELISA. See, for example, Martin et al. (2003) *Nature Biotechnology* 21:71-76.

HIV infection does not need to be completely eliminated for the composition to be effective. For example, a composition can decrease HIV infection by a desired amount, for example by at least 10%, at least 20%, at least 50%, at least 60%, at least 70%, at least 80%, at least 90%, at least 95%, at least 98%, or even at least 100% (elimination of detectable HIV infected cells), as compared to HIV infection in the absence of the composition. In some embodiments, the cell is also contacted with a therapeutically effective amount of an additional agent, such as anti-viral agent. The cell can be in vivo or in vitro. The methods can include administration of one on more additional agents known in the art. In additional embodiments, HIV replication can be reduced or inhibited by similar methods. HIV replication does not need to be completely eliminated for the composition to be effective. For example, a composition can decrease HIV replication by a desired amount, for example by at least 10%, at least 20%, at least 50%, at least 60%, at least 70%, at least 80%, at least 90%, at least 95%, at least 98%, or even at least 100% (elimination of detectable HIV), as compared to HIV replication in the absence of the composition. In one example, the cell is also contacted with a therapeutically effective amount of an additional agent, such as anti-viral agent. The cell can be in vivo or in vitro.

Compositions are provided that include one or more of the antibodies that specifically bind gp120, or binding fragment thereof or a nucleic acid encoding such antibodies or antigen binding fragments, that are disclosed herein in a carrier. The compositions can be prepared in unit dosage forms for administration to a subject. The amount and timing of administration are at the discretion of the treating physician to achieve the desired purposes. The antibody can be formulated for systemic or local administration. In one example, the antibody that specifically binds gp120, or an antigen binding fragment thereof or a nucleic acid encoding such antibodies or antigen binding fragments, is formulated for parenteral administration, such as intravenous administration.

The compositions for administration can include a solution of the antibody that specifically binds gp120, or an antigen binding fragment thereof or an nucleic acid encoding such antibodies or antibody binding fragments, dissolved in a pharmaceutically acceptable carrier, such as an aqueous carrier. A variety of aqueous carriers can be used, for example, buffered saline and the like. These solutions are sterile and generally free of undesirable matter. These compositions may be sterilized by conventional, well known sterilization techniques. The compositions may contain pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate and the like. The concentration of antibody in these formulations can vary widely, and will be selected primarily based on fluid volumes, viscosities, body weight and the like in accordance with the particular mode of administration selected and the subject's needs.

A typical pharmaceutical composition for intravenous administration includes about 0.1 to 10 mg of antibody per subject per day. Dosages from 0.1 up to about 100 mg per subject per day may be used, particularly if the agent is administered to a secluded site and not into the circulatory or lymph system, such as into a body cavity or into a lumen of an organ. Actual methods for preparing administrable compositions will be known or apparent to those skilled in the art and are described in more detail in such publications as *Remington's Pharmaceutical Science,* 19th ed., Mack Publishing Company, Easton, Pa. (1995).

Antibodies, or an antigen binding fragment thereof or an nucleic acid encoding such an antibodies or antigen binding fragments, may be provided in lyophilized form and rehydrated with sterile water before administration, although they are also provided in sterile solutions of known concentration. The antibody solution, or an antigen binding fragment or an nucleic acid encoding such antibodies or antibody binding fragments, is then added to an infusion bag containing 0.9% sodium chloride, USP, and typically administered at a dosage of from 0.5 to 15 mg/kg of body weight. Considerable experience is available in the art in the administration of antibody drugs, which have been marketed in the U.S. since the approval of RITUXAN® in 1997. Antibodies, or an antigen binding fragment thereof or an nucleic acid encoding such antibodies or antigen binding fragments, can be administered by slow infusion, rather than in an intravenous push or bolus. In one example, a higher loading dose is administered, with subsequent, maintenance doses being administered at a lower level. For example, an initial loading dose of 4 mg/kg may be infused over a period of some 90 minutes, followed by weekly maintenance doses for 4-8 weeks of 2 mg/kg infused over a 30 minute period if the previous dose was well tolerated.

A therapeutically effective amount of a gp120-specific antibody, or an antigen binding fragment thereof or an nucleic acid encoding such antibodies or antibody binding fragments, will depend upon the severity of the disease and/or infection and the general state of the patient's health. A therapeutically effective amount of the antibody is that which provides either subjective relief of a symptom(s) or an objectively identifiable improvement as noted by the clinician or other qualified observer. These compositions can be administered in conjunction with another therapeutic agent, either simultaneously or sequentially.

In one embodiment, administration of the antibody, or antibody binding fragment or an nucleic acid encoding such antibodies or antibody binding fragments, results in a reduction in the establishment of HIV infection and/or reducing subsequent HIV disease progression in a subject. A reduction in the establishment of HIV infection and/or a reduction in subsequent HIV disease progression encompass any statistically significant reduction in HIV activity. In some embodiments, methods are disclosed for treating a subject with an HIV-1 infection. These methods include administering to the subject a therapeutically effective amount of an antibody, or a nucleic acid encoding the antibody, thereby preventing or treating the HIV-1 infection.

Studies have shown that the rate of HIV transmission from mother to infant is reduced significantly when zidovudine is administered to HIV-infected women during pregnancy and delivery and to the offspring after birth (Connor et al., 1994 *Pediatr Infect Dis J* 14: 536-541). Several studies of mother-to-infant transmission of HIV have demonstrated a correlation between the maternal virus load at delivery and risk of HIV transmission to the child. The present disclosure provides isolated human monoclonal antibodies that are of use in decreasing HIV-transmission from mother to infant. Thus, in some examples, a therapeutically effective amount of a human gp120-specific antibody or antigen binding fragment thereof or nucleic acid encoding such antibodies or antibody antigen binding fragments, is administered in order to prevent transmission of HIV, or decrease the risk of transmission of HIV, from a mother to an infant. In some examples, a therapeutically effective amount of the antibody, or an antibody binding fragment or nucleic acid encoding such antibodies or antigen binding fragment, is administered to mother and/or to the child at childbirth. In other examples, a therapeutically effective amount of the antibody, antigen binding fragment, or nucleic acid encoding the antibody or antigen binding fragment is administered to the mother and/or infant prior to breast feeding in order to prevent viral transmission to the infant or decrease the risk of viral transmission to the infant. In some embodiments, both a therapeutically effective amount of the antibody, antigen binding fragment, or nucleic acid encoding the antibody or antigen binding fragment and a therapeutically effective amount of another agent, such as zidovudine, is administered to the mother and/or infant.

For any application, the antibody, antigen binding fragment, or nucleic acid encoding the antibody or antigen binding fragment can be combined with anti-retroviral therapy. Antiretroviral drugs are broadly classified by the phase of the retrovirus life-cycle that the drug inhibits. The disclosed antibodies can be administered in conjunction with nucleoside analog reverse-transcriptase inhibitors (such as zidovudine, didanosine, zalcitabine, stavudine, lamivudine, abacavir, emtricitabine, entecavir, and apricitabine), nucleotide reverse transcriptase inhibitors (such as tenofovir and adefovir), non-nucleoside reverse transcriptase inhibitors (such as efavirenz, nevirapine, delavirdine, etravirine, and rilpivirine), protease inhibitors (such as saquinavir, ritonavir, indinavir, nelfinavir, amprenavir, lopinavir, fosamprenavir, atazanavir, tipranavir, and darunavir), entry or fusion inhibitors (such as maraviroc and enfuvirtide), maturation inhibitors, (such as bevirimat and vivecon), or a broad spectrum inhibitors, such as natural antivirals. In some examples, a disclosed antibody or active fragment thereof or nucleic acids encoding such is administered in conjunction with IL-15, or conjugated to IL-15.

In some examples, a subject is further administered one or more additional antibodies that bind HIV glycoproteins, such as gp120 and gp41. Examples of neutralizing antibodies that can be administered in conjunction with the disclosed antibodies can be found in International Patent Publication No. WO 2011/038290, published Mar. 31, 2011, which is specifically incorporated herein by reference in its entirety.

Single or multiple administrations of the compositions including the antibody, antigen binding fragment, or nucleic acid encoding the antibody or antigen binding fragment, that are disclosed herein, are administered depending on the dosage and frequency as required and tolerated by the patient. In any event, the composition should provide a sufficient quantity of at least one of the antibodies disclosed herein to effectively treat the patient. The dosage can be administered once, but may be applied periodically until either a therapeutic result is achieved or until side effects warrant discontinuation of therapy. In one example, a dose of the antibody is infused for thirty minutes every other day. In this example, about one to about ten doses can be administered, such as three or six doses can be administered every other day. In a further example, a continuous infusion is administered for about five to about ten days. The subject can be treated at regular intervals, such as monthly, until a desired therapeutic result is achieved. Generally, the dose is sufficient to treat or ameliorate symptoms or signs of disease without producing unacceptable toxicity to the patient.

Controlled-release parenteral formulations can be made as implants, oily injections, or as particulate systems. For a broad overview of protein delivery systems see, Banga, A. J., *Therapeutic Peptides and Proteins: Formulation, Processing, and Delivery Systems*, Technomic Publishing Company, Inc., Lancaster, Pa., (1995). Particulate systems include microspheres, microparticles, microcapsules, nanocapsules, nanospheres, and nanoparticles. Microcapsules contain the therapeutic protein, such as a cytotoxin or a drug, as a central core. In microspheres the therapeutic is dispersed throughout the particle. Particles, microspheres, and microcapsules smaller than about 1 μm are generally referred to as nanoparticles, nanospheres, and nanocapsules, respectively. Capillaries have a diameter of approximately 5 μm so that only nanoparticles are administered intravenously. Microparticles are typically around 100 μm in diameter and are administered subcutaneously or intramuscularly. See, for example, Kreuter, J., *Colloidal Drug Delivery Systems*, J. Kreuter, ed., Marcel Dekker, Inc., New York, N.Y., pp. 219-342 (1994); and Tice & Tabibi, *Treatise on Controlled Drug Delivery*, A. Kydonieus, ed., Marcel Dekker, Inc. New York, N.Y., pp. 315-339, (1992).

Polymers can be used for ion-controlled release of the antibody compositions disclosed herein. Various degradable and nondegradable polymeric matrices for use in controlled drug delivery are known in the art (Langer, *Accounts Chem. Res.* 26:537-542, 1993). For example, the block copolymer, polaxamer 407, exists as a viscous yet mobile liquid at low temperatures but forms a semisolid gel at body temperature. It has been shown to be an effective vehicle for formulation and sustained delivery of recombinant interleukin-2 and urease (Johnston et al., *Pharm. Res.* 9:425-434, 1992; and Pec et al., *J. Parent. Sci. Tech.* 44(2):58-65, 1990). Alternatively, hydroxyapatite has been used as a microcarrier for controlled release of proteins (Ijntema et al., *Int. J. Pharm.* 112:215-224, 1994). In yet another aspect, liposomes are used for controlled release as well as drug targeting of the lipid-capsulated drug (Betageri et al., *Liposome Drug Delivery Systems*, Technomic Publishing Co., Inc., Lancaster, Pa. (1993)). Numerous additional systems for controlled delivery of therapeutic proteins are known (see U.S. Pat. No. 5,055,303; U.S. Pat. No. 5,188,837; U.S. Pat. No. 4,235,871; U.S. Pat. No. 4,501,728; U.S. Pat. No. 4,837,028; U.S. Pat. No. 4,957,735; U.S. Pat. No. 5,019,369; U.S. Pat. No. 5,055,303; U.S. Pat. No. 5,514,670; U.S. Pat. No. 5,413,797; U.S. Pat. No. 5,268,164; U.S. Pat. No. 5,004,697; U.S. Pat. No. 4,902,505; U.S. Pat. No. 5,506,206; U.S. Pat. No. 5,271,961; U.S. Pat. No. 5,254,342 and U.S. Pat. No. 5,534,496).

In some examples, a subject is administered the DNA encoding the antibody or antigen binding fragments thereof, or one or more of the CDRs grafted onto a protein scaffold, to provide in vivo antibody production, for example using the cellular machinery of the subject. Immunization by nucleic acid constructs is well known in the art and taught, for example, in U.S. Pat. No. 5,643,578, and U.S. Pat. No. 5,593,972 and U.S. Pat. No. 5,817,637. U.S. Pat. No. 5,880,103 describes several methods of delivery of nucleic acids encoding to an organism. The methods include liposomal delivery of the nucleic acids. Such methods can be applied to the production of an antibody, or antibody binding fragments thereof, by one of ordinary skill in the art.

One approach to administration of nucleic acids is direct administration with plasmid DNA, such as with a mammalian expression plasmid. The nucleotide sequence encoding the disclosed antibody, or antibody binding fragments thereof, can be placed under the control of a promoter to increase expression.

In another approach to using nucleic acids, a disclosed antibody, or antibody binding fragments thereof can also be expressed by attenuated viral hosts or vectors or bacterial vectors. Recombinant vaccinia virus, adeno-associated virus (AAV), herpes virus, retrovirus, cytomegalovirus or other viral vectors can be used to express the antibody. For example, vaccinia vectors and methods useful protocols are described in U.S. Pat. No. 4,722,848. BCG (Bacillus Calmette Guerin) provides another vector for expression of the disclosed antibodies (see Stover, *Nature* 351:456-460, 1991).

In one embodiment, a nucleic acid encoding a disclosed antibody, or antibody binding fragments thereof, is introduced directly into cells. For example, the nucleic acid can be loaded onto gold microspheres by standard methods and introduced into the skin by a device such as Bio-Rad's HELIOS™ Gene Gun. The nucleic acids can be "naked," consisting of plasmids under control of a strong promoter.

Typically, the DNA is injected into muscle, although it can also be injected directly into other sites. Dosages for injection are usually around 0.5 μg/kg to about 50 mg/kg, and typically are about 0.005 mg/kg to about 5 mg/kg (see, e.g., U.S. Pat. No. 5,589,466).

C. Diagnostic Methods and Kits

A method is provided herein for the detection of the expression of gp120 in vitro or in vivo. In one example, expression of gp120 is detected in a biological sample, and can be used to detect HIV-1 infection as the presence of HIV-1 in a sample. The sample can be any sample, including, but not limited to, tissue from biopsies, autopsies and pathology specimens. Biological samples also include sections of tissues, for example, frozen sections taken for histological purposes. Biological samples further include body fluids, such as blood, serum, plasma, sputum, spinal fluid or urine.

In several embodiments, a method is provided for detecting AIDS and/or an HIV-1 infection in a subject. The disclosure provides a method for detecting HIV-1 in a biological sample, wherein the method includes contacting a biological sample with the antibody under conditions conducive to the formation of an immune complex, and detecting the immune complex, to detect the gp120 in the biological sample. In one example, the detection of gp120 in the sample indicates that the subject has an HIV infection. In another example, the detection of gp120 in the sample indicates that the subject has AIDS. In another example, detection of gp120 in the sample confirms a diagnosis of AIDS and/or an HIV-1 infection in a subject.

In some embodiments, the disclosed antibodies are used to test vaccines. For example to test if a vaccine composition assumes the same conformation as a gp120 peptide. Thus provided herein is a method for testing a vaccine, wherein the method includes contacting a sample containing the vaccine, such as a gp120 immunogen, with the antibody under conditions conducive to the formation of an immune complex, and detecting the immune complex, to detect the vaccine in the sample. In one example, the detection of the immune complex in the sample indicates that vaccine component, such as such as a gp120 immunogen assumes a conformation capable of binding the antibody.

In one embodiment, the antibody is directly labeled with a detectable label. In another embodiment, the antibody that binds gp120 (the first antibody) is unlabeled and a second antibody or other molecule that can bind the antibody that binds gp120 is utilized. As is well known to one of skill in the art, a second antibody is chosen that is able to specifically bind the specific species and class of the first antibody. For example, if the first antibody is a human IgG, then the secondary antibody may be an anti-human-IgG. Other molecules that can bind to antibodies include, without limitation, Protein A and Protein G, both of which are available commercially.

Suitable labels for the antibody or secondary antibody are described above, and include various enzymes, prosthetic groups, fluorescent materials, luminescent materials, magnetic agents and radioactive materials. Non-limiting examples of suitable enzymes include horseradish peroxidase, alkaline phosphatase, beta-galactosidase, or acetylcholinesterase. Non-limiting examples of suitable prosthetic group complexes include streptavidin/biotin and avidin/biotin. Non-limiting examples of suitable fluorescent materials include umbelliferone, fluorescein, fluorescein isothiocyanate, rhodamine, dichlorotriazinylamine fluorescein, dansyl chloride or phycoerythrin. A non-limiting exemplary luminescent material is luminol; a non-limiting exemplary a magnetic agent is gadolinium, and non-limiting exemplary radioactive labels include $^{125}I$, $^{131}I$, $^{35}S$ or $^{3}H$.

The immunoassays and methods disclosed herein can be used for a number of purposes. Kits for detecting a polypeptide will typically include an antibody that binds gp120, such as any of the antibodies disclosed herein. In some embodiments, an antibody fragment, such as an Fv fragment or a Fab is included in the kit. In a further embodiment, the antibody is labeled (for example, with a fluorescent, radioactive, or an enzymatic label).

In one embodiment, a kit includes instructional materials disclosing means of use. The instructional materials may be written, in an electronic form (such as a computer diskette or compact disk) or may be visual (such as video files). The kits may also include additional components to facilitate the particular application for which the kit is designed. Thus, for example, the kit may additionally contain means of detecting a label (such as enzyme substrates for enzymatic labels, filter sets to detect fluorescent labels, appropriate secondary labels such as a secondary antibody, or the like). The kits may additionally include buffers and other reagents routinely used for the practice of a particular method. Such kits and appropriate contents are well known to those of skill in the art.

In one embodiment, the diagnostic kit includes an immunoassay. Although the details of the immunoassays may vary with the particular format employed, the method of detecting gp120 in a biological sample generally includes the steps of contacting the biological sample with an antibody which specifically reacts, under immunologically reactive conditions, to gp120. The antibody is allowed to specifically bind under immunologically reactive conditions to form an immune complex, and the presence of the immune complex (bound antibody) is detected directly or indirectly.

D. Exemplary Embodiments of the Disclosure

Clause 1. An isolated monoclonal antibody, comprising a heavy chain variable domain and a light chain variable domain, wherein a heavy chain variable domain of the antibody comprises amino acids 26-33 (CDR1), 51-58 (CDR2) and/or 97-114 (CDR3) of SEQ ID NO: 1, and wherein the antibody specifically binds gp120 of HIV-1, and wherein the antibody is neutralizing.

Clause 2. The isolated monoclonal antibody of clause 1, wherein the heavy chain variable domain comprises one of:

(a) amino acids 26-33 (CDR1), 51-58 (CDR2) and/or 97-114 (CDR3) of SEQ ID NO: 2;

(b) amino acids 26-33 (CDR1), 51-58 (CDR2) and/or 97-114 (CDR3) of SEQ ID NO: 3;

(c) amino acids 26-33 (CDR1), 51-58 (CDR2) and/or 97-114 (CDR3) of SEQ ID NO: 4;

(d) amino acids 26-33 (CDR1), 51-58 (CDR2) and/or 97-114 (CDR3) of SEQ ID NO: 30; or (e) amino acids 26-33 (CDR1), 51-58 (CDR2) and/or 97-114 (CDR3) of SEQ ID NO: 38.

Clause 3. The isolated human monoclonal antibody of clause 1, wherein the heavy chain domain of the antibody comprises amino acids 26-33 (CDR1), 51-58 (CDR2) and 97-114 (CDR3) of SEQ ID NO: 1.

Clause 4. The isolated monoclonal antibody of clause 1, wherein the heavy chain variable domain comprises one of:

(a) amino acids 26-33 (CDR1), 51-58 (CDR2) and 97-114 (CDR3) of SEQ ID NO: 2;

(b) amino acids 26-33 (CDR1), 51-58 (CDR2) and 97-114 (CDR3) of SEQ ID NO: 3;

(c) amino acids 26-33 (CDR1), 51-58 (CDR2) and 97-114 (CDR3) of SEQ ID NO: 4;

(d) amino acids 26-33 (CDR1), 51-58 (CDR2) and 97-114 (CDR3) of SEQ ID NO: 30; or (e) amino acids 26-33 (CDR1), 51-58 (CDR2) and 97-114 (CDR3) of SEQ ID NO: 38.

Clause 5. The isolated monoclonal antibody of any one of clauses 1-4, wherein the heavy chain variable domain of the antibody comprises SEQ ID NO: 1.

Clause 6. The isolated monoclonal antibody of any one of clauses 1-5, wherein the heavy chain variable domain of the antibody comprises one of SEQ ID NO: 2-4.

Clause 7. The isolated monoclonal antibody of clause 1, wherein the heavy chain variable domain of the antibody comprises one of:

(a) amino acids 26-33 (CDR1), 51-58 (CDR2) and/or 97-114 (CDR3) of SEQ ID NO: 31;

(b) amino acids 26-33 (CDR1), 51-58 (CDR2) and/or 97-114 (CDR3) of SEQ ID NO: 32;

(c) amino acids 26-33 (CDR1), 51-58 (CDR2) and/or 97-114 (CDR3) of SEQ ID NO: 33;

(d) amino acids 26-33 (CDR1), 51-58 (CDR2) and/or 97-114 (CDR3) of SEQ ID NO: 34

(e) amino acids 26-33 (CDR1), 51-58 (CDR2) and/or 97-114 (CDR3) of SEQ ID NO: 35; or (e) amino acids 26-33 (CDR1), 51-58 (CDR2) and/or 97-114 (CDR3) of SEQ ID NO: 36.

Clause 8. The isolated monoclonal antibody of clause 7, wherein the heavy chain variable domain of the antibody comprises one of:

(a) amino acids 26-33 (CDR1), 51-58 (CDR2) and 97-114 (CDR3) of SEQ ID NO: 31;
(b) amino acids 26-33 (CDR1), 51-58 (CDR2) and 97-114 (CDR3) of SEQ ID NO: 32;
(c) amino acids 26-33 (CDR1), 51-58 (CDR2) and 97-114 (CDR3) of SEQ ID NO: 33;
(d) amino acids 26-33 (CDR1), 51-58 (CDR2) and 97-114 (CDR3) of SEQ ID NO: 34
(e) amino acids 26-33 (CDR1), 51-58 (CDR2) and 97-114 (CDR3) of SEQ ID NO: 35; or
(e) amino acids 26-33 (CDR1), 51-58 (CDR2) and 97-114 (CDR3) of SEQ ID NO: 36.

Clause 9. The isolated monoclonal antibody of any one of clauses 7-8, wherein the heavy chain variable domain of the antibody comprises one of:
(a) SEQ ID NO: 31;
(b) SEQ ID NO: 32;
(c) SEQ ID NO: 33;
(d) SEQ ID NO: 34
(e) SEQ ID NO: 35; or
(e) SEQ ID NO: 36.

Clause 10. The isolated monoclonal antibody of clause 1, wherein the heavy chain variable domain comprises one of
(a) amino acids 26-33 (CDR1), 51-58 (CDR2) and/or 97-114 (CDR3) of SEQ ID NO: 38, wherein $X_{15}$ is Q; $X_{16}$ is V or I and $X_{17}$ is A or T;
(b) amino acids 26-33 (CDR1), 51-58 (CDR2) and/or 97-114 (CDR3) of SEQ ID NO: 38, wherein $X_{15}$ is Q or R; $X_{16}$ is V and $X_{17}$ is A or T;
(c) amino acids 26-33 (CDR1), 51-58 (CDR2) and/or 97-114 (CDR3) of SEQ ID NO: 38, wherein $X_{15}$ is Q or R; $X_{16}$ is V or I and $X_{17}$ is A;
(d) amino acids 26-33 (CDR1), 51-58 (CDR2) and/or 97-114 (CDR3) of SEQ ID NO: 38, wherein $X_{15}$ is Q; $X_{16}$ is V and $X_{17}$ is A or T;
(e) amino acids 26-33 (CDR1), 51-58 (CDR2) and/or 97-114 (CDR3) of SEQ ID NO: 38, wherein $X_{15}$ is Q or R; $X_{16}$ is V and $X_{17}$ is A;
(f) amino acids 26-33 (CDR1), 51-58 (CDR2) and/or 97-114 (CDR3) of SEQ ID NO: 38, wherein $X_{15}$ is Q; $X_{16}$ is V or I and $X_{17}$ is A; or
(g) amino acids 26-33 (CDR1), 51-58 (CDR2) and/or 97-114 (CDR3) of SEQ ID NO: 39.

Clause 11. The isolated monoclonal antibody of clause 10, wherein the heavy chain variable domain comprises one of
(a) amino acids 26-33 (CDR1), 51-58 (CDR2) and 97-114 (CDR3) of SEQ ID NO: 38, wherein $X_{15}$ is Q; $X_{16}$ is V or I and $X_{17}$ is A or T;
(b) amino acids 26-33 (CDR1), 51-58 (CDR2) and 97-114 (CDR3) of SEQ ID NO: 38, wherein $X_{15}$ is Q or R; $X_{16}$ is V and $X_{17}$ is A or T;
(c) amino acids 26-33 (CDR1), 51-58 (CDR2) and 97-114 (CDR3) of SEQ ID NO: 38, wherein $X_{15}$ is Q or R; $X_{16}$ is V or I and $X_{17}$ is A;
(d) amino acids 26-33 (CDR1), 51-58 (CDR2) and 97-114 (CDR3) of SEQ ID NO: 38, wherein $X_{15}$ is Q; $X_{16}$ is V and $X_{17}$ is A or T;
(e) amino acids 26-33 (CDR1), 51-58 (CDR2) and 97-114 (CDR3) of SEQ ID NO: 38, wherein $X_{15}$ is Q or R; $X_{16}$ is V and $X_{17}$ is A;
(f) amino acids 26-33 (CDR1), 51-58 (CDR2) and 97-114 (CDR3) of SEQ ID NO: 38, wherein $X_{15}$ is Q; $X_{16}$ is V or I and $X_{17}$ is A; or
(g) amino acids 26-33 (CDR1), 51-58 (CDR2) and 97-114 (CDR3) of SEQ ID NO: 39.

Clause 12. The isolated monoclonal antibody of clause 10 or clause 11, wherein the heavy chain variable domain comprises:
(a) the amino acid sequence set forth as SEQ ID NO: 38, wherein $X_{15}$ is Q; $X_{16}$ is V or I and $X_{17}$ is A or T;
(b) the amino acid sequence set forth as SEQ ID NO: 38, wherein $X_{15}$ is Q or R; $X_{16}$ is V and $X_{17}$ is A or T;
(c) the amino acid sequence set forth as SEQ ID NO: 38, wherein $X_{15}$ is Q or R; $X_{16}$ is V or I and $X_{17}$ is A;
(d) the amino acid sequence set forth as SEQ ID NO: 38, wherein $X_{15}$ is Q; $X_{16}$ is V and $X_{17}$ is A or T;
(e) the amino acid sequence set forth as SEQ ID NO: 38, wherein $X_{15}$ is Q or R; $X_{16}$ is V and $X_{17}$ is A;
(f) the amino acid sequence set forth as SEQ ID NO: 38, wherein $X_{15}$ is Q; $X_{16}$ is V or I and $X_{17}$ is A; or
(g) the amino acid sequence set forth as SEQ ID NO: 39.

Clause 13. An isolated monoclonal antibody, comprising a heavy chain variable domain and a light chain variable domain, wherein a heavy chain variable domain of the antibody comprises amino acids 26-33 (CDR1), 51-58 (CDR2) and/or 97-114 (CDR3) of SEQ ID NO: 23, and wherein the antibody specifically binds gp120 of HIV-1, and wherein the antibody is neutralizing.

Clause 14. The isolated monoclonal antibody of clause 13, wherein the heavy chain variable domain comprises one of:
(a) amino acids 26-33 (CDR1), 51-58 (CDR2) and/or 97-114 (CDR3) of SEQ ID NO: 24;
(b) amino acids 26-33 (CDR1), 51-58 (CDR2) and/or 97-114 (CDR3) of SEQ ID NO: 25; or
(c) amino acids 26-33 (CDR1), 51-58 (CDR2) and/or 97-114 (CDR3) of SEQ ID NO: 26.

Clause 15. The isolated human monoclonal antibody of clause 13, wherein the heavy chain domain of the antibody comprises amino acids 26-33 (CDR1), 51-58 (CDR2) and 97-114 (CDR3) of SEQ ID NO: 23.

Clause 16. The isolated monoclonal antibody of clause 14, wherein the heavy chain variable domain comprises one of:
(a) amino acids 26-33 (CDR1), 51-58 (CDR2) and 97-114 (CDR3) of SEQ ID NO: 24;
(b) amino acids 26-33 (CDR1), 51-58 (CDR2) and 97-114 (CDR3) of SEQ ID NO: 25; or
(c) amino acids 26-33 (CDR1), 51-58 (CDR2) and 97-114 (CDR3) of SEQ ID NO: 26. Clause 17. The isolated monoclonal antibody of any one of clauses 2-6 or 13-15, wherein the heavy chain variable domain of the antibody comprises SEQ ID NO: 23.

Clause 18. The isolated monoclonal antibody of any one of 13-15, wherein the heavy chain variable domain of the antibody comprises one of SEQ ID NOs: 24-26.

Clause 19. The isolated monoclonal antibody of any one of clauses 1-18, wherein in the light chain variable domain of the isolated human monoclonal antibody includes amino acids 27-30 (CDR1), 48-50 (CDR2) and 87-91 (CDR3) of SEQ ID NO: 6.

Clause 20. The isolated monoclonal antibody of any one of clauses 1-18, wherein the light chain variable domain of the antibody comprises one of:
(a) amino acids 27-30 (CDR1), 48-50 (CDR2) and 87-91 (CDR3) of SEQ ID NO: 7;
(b) amino acids 27-30 (CDR1), 48-50 (CDR2) and 87-91 (CDR3) of SEQ ID NO: 8.

Clause 21. The isolated monoclonal antibody of any one of clauses 1-1, wherein in the light chain variable domain of the isolated human monoclonal antibody includes amino acids 27-30 (CDR1), 48-50 (CDR2) and 87-91 (CDR3) of SEQ ID NO: 9.

Clause 22. The isolated monoclonal antibody of any one of clauses 1-18, wherein in the light chain variable domain of the isolated human monoclonal antibody includes amino acids 27-30 (CDR1), 48-50 (CDR2) and 87-91 (CDR3) of SEQ ID NO: 27.

Clause 23. The isolated monoclonal antibody of any one of clauses 1-18, wherein the light chain variable domain of the antibody comprises SEQ ID NO: 6, SEQ ID NO: 7, SEQ ID NO: 8, SEQ ID NO: 9 or SEQ ID NO: 27.

Clause 24. The isolated monoclonal antibody of clause 1, wherein (a) the heavy chain variable domain comprises amino acids 26-33 (CDR1), 51-58 (CDR2) and 97-114 (CDR3) of SEQ ID NO: 1, and the light chain variable domain comprises amino acids 27-30 (CDR1), 48-50 (CDR2) and 87-91 (CDR3) of SEQ ID NO: 6;

(b) the heavy chain variable domain comprises amino acids 26-33 (CDR1), 51-58 (CDR2) and 97-114 (CDR3) of SEQ ID NO: 2 and the light chain variable domain comprises amino acids 27-30 (CDR1), 48-50 (CDR2) and 87-91 (CDR3) of SEQ ID NO: 9;

(c) the heavy chain variable domain comprises amino acids 26-33 (CDR1), 51-58 (CDR2) and 97-114 (CDR3) of SEQ ID NO:3 and the light chain variable domain comprises amino acids 27-30 (CDR1), 48-50 (CDR2) and 87-91 (CDR3) of SEQ ID NO: 7; or (d) the heavy chain variable domain comprises amino acids 26-33 (CDR1), 51-58 (CDR2) and 97-114 (CDR3) of SEQ ID NO: 4 and the light chain variable domain comprises amino acids 27-30 (CDR1), 48-50 (CDR2) and 87-91 (CDR3) of SEQ ID NO: 8.

Clause 25. The isolated monoclonal antibody of clause 13, wherein (a) the heavy chain variable domain comprises amino acids 26-33 (CDR1), 51-58 (CDR2) and 97-114 (CDR3) of SEQ ID NO: 23 and the light chain variable domain comprises amino acids 27-30 (CDR1), 48-50 (CDR2) and 87-91 (CDR3) of SEQ ID NO: 9;

(b) the heavy chain variable domain comprises amino acids 26-33 (CDR1), 51-58 (CDR2) and 97-114 (CDR3) of SEQ ID NO: 24 and the light chain variable domain comprises amino acids 27-30 (CDR1), 48-50 (CDR2) and 87-91 (CDR3) of SEQ ID NO: 9;

(c) the heavy chain variable domain comprises amino acids 26-33 (CDR1), 51-58 (CDR2) and 97-114 (CDR3) of SEQ ID NO: 25 and the light chain variable domain comprises amino acids 27-30 (CDR1), 48-50 (CDR2) and 87-91 (CDR3) of SEQ ID NO: 9;

(d) the heavy chain variable domain comprises amino acids 26-33 (CDR1), 51-58 (CDR2) and 97-114 (CDR3) of SEQ ID NO: 26 and the light chain variable domain comprises amino acids 27-30 (CDR1), 48-50 (CDR2) and 87-91 (CDR3) of SEQ ID NO: 9;

(e) the heavy chain variable domain comprises amino acids 26-33 (CDR1), 51-58 (CDR2) and 97-114 (CDR3) of SEQ ID NO: 23 and the light chain variable domain comprises amino acids 27-30 (CDR1), 48-50 (CDR2) and 87-91 (CDR3) of SEQ ID NO: 27;

(f) the heavy chain variable domain comprises amino acids 26-33 (CDR1), 51-58 (CDR2) and 97-114 (CDR3) of SEQ ID NO: 24 and the light chain variable domain comprises amino acids 27-30 (CDR1), 48-50 (CDR2) and 87-91 (CDR3) of SEQ ID NO: 27;

(g) the heavy chain variable domain comprises amino acids 26-33 (CDR1), 51-58 (CDR2) and 97-114 (CDR3) of SEQ ID NO: 25 and the light chain variable domain comprises amino acids 27-30 (CDR1), 48-50 (CDR2) and 87-91 (CDR3) of SEQ ID NO: 27; or (h) the heavy chain variable domain comprises amino acids 26-33 (CDR1), 51-58 (CDR2) and 97-114 (CDR3) of SEQ ID NO: 26 and the light chain variable domain comprises amino acids 27-30 (CDR1), 48-50 (CDR2) and 87-91 (CDR3) of SEQ ID NO: 27.

Clause 26. The isolated monoclonal antibody of any one of clauses 7-9, wherein (a) the heavy chain variable domain comprises amino acids 26-33 (CDR1), 51-58 (CDR2) and 97-114 (CDR3) of SEQ ID NO: 30, and the light chain variable domain comprises amino acids 27-30 (CDR1), 48-50 (CDR2) and 87-91 (CDR3) of SEQ ID NO: 6;

(b) the heavy chain variable domain comprises amino acids 26-33 (CDR1), 51-58 (CDR2) and 97-114 (CDR3) of SEQ ID NO: 30 and the light chain variable domain comprises amino acids 27-30 (CDR1), 48-50 (CDR2) and 87-91 (CDR3) of SEQ ID NO: 9;

(c) the heavy chain variable domain comprises amino acids 26-33 (CDR1), 51-58 (CDR2) and 97-114 (CDR3) of SEQ ID NO:30 and the light chain variable domain comprises amino acids 27-30 (CDR1), 48-50 (CDR2) and 87-91 (CDR3) of SEQ ID NO: 7;

(d) the heavy chain variable domain comprises amino acids 26-33 (CDR1), 51-58 (CDR2) and 97-114 (CDR3) of SEQ ID NO: 30 and the light chain variable domain comprises amino acids 27-30 (CDR1), 48-50 (CDR2) and 87-91 (CDR3) of SEQ ID NO: 8;

(e) the heavy chain variable domain comprises amino acids 26-33 (CDR1), 51-58 (CDR2) and 97-114 (CDR3) of SEQ ID NO: 30 and the light chain variable domain comprises amino acids 27-30 (CDR1), 48-50 (CDR2) and 87-91 (CDR3) of SEQ ID NO: 27;

(f) the heavy chain variable domain comprises amino acids 26-33 (CDR1), 51-58 (CDR2) and 97-114 (CDR3) of SEQ ID NO: 31, and the light chain variable domain comprises amino acids 27-30 (CDR1), 48-50 (CDR2) and 87-91 (CDR3) of SEQ ID NO: 6;

(g) the heavy chain variable domain comprises amino acids 26-33 (CDR1), 51-58 (CDR2) and 97-114 (CDR3) of SEQ ID NO: 31 and the light chain variable domain comprises amino acids 27-30 (CDR1), 48-50 (CDR2) and 87-91 (CDR3) of SEQ ID NO: 9;

(h) the heavy chain variable domain comprises amino acids 26-33 (CDR1), 51-58 (CDR2) and 97-114 (CDR3) of SEQ ID NO: 31 and the light chain variable domain comprises amino acids 27-30 (CDR1), 48-50 (CDR2) and 87-91 (CDR3) of SEQ ID NO: 7;

(i) the heavy chain variable domain comprises amino acids 26-33 (CDR1), 51-58 (CDR2) and 97-114 (CDR3) of SEQ ID NO: 31 and the light chain variable domain comprises amino acids 27-30 (CDR1), 48-50 (CDR2) and 87-91 (CDR3) of SEQ ID NO: 8;

(j) the heavy chain variable domain comprises amino acids 26-33 (CDR1), 51-58 (CDR2) and 97-114 (CDR3) of SEQ ID NO: 31 and the light chain variable domain comprises amino acids 27-30 (CDR1), 48-50 (CDR2) and 87-91 (CDR3) of SEQ ID NO: 27;

(k) the heavy chain variable domain comprises amino acids 26-33 (CDR1), 51-58 (CDR2) and 97-114 (CDR3) of SEQ ID NO: 32, and the light chain variable domain comprises amino acids 27-30 (CDR1), 48-50 (CDR2) and 87-91 (CDR3) of SEQ ID NO: 6;

(l) the heavy chain variable domain comprises amino acids 26-33 (CDR1), 51-58 (CDR2) and 97-114 (CDR3) of SEQ ID NO: 32 and the light chain variable domain comprises amino acids 27-30 (CDR1), 48-50 (CDR2) and 87-91 (CDR3) of SEQ ID NO: 9;

(m) the heavy chain variable domain comprises amino acids 26-33 (CDR1), 51-58 (CDR2) and 97-114 (CDR3) of SEQ ID NO:32 and the light chain variable domain comprises amino acids 27-30 (CDR1), 48-50 (CDR2) and 87-91 (CDR3) of SEQ ID NO: 7;

(n) the heavy chain variable domain comprises amino acids 26-33 (CDR1), 51-58 (CDR2) and 97-114 (CDR3) of SEQ ID NO: 32 and the light chain variable domain comprises amino acids 27-30 (CDR1), 48-50 (CDR2) and 87-91 (CDR3) of SEQ ID NO: 8;

(o) the heavy chain variable domain comprises amino acids 26-33 (CDR1), 51-58 (CDR2) and 97-114 (CDR3) of SEQ ID NO: 32 and the light chain variable domain comprises amino acids 27-30 (CDR1), 48-50 (CDR2) and 87-91 (CDR3) of SEQ ID NO: 27;

(p) the heavy chain variable domain comprises amino acids 26-33 (CDR1), 51-58 (CDR2) and 97-114 (CDR3) of SEQ ID NO: 33, and the light chain variable domain comprises amino acids 27-30 (CDR1), 48-50 (CDR2) and 87-91 (CDR3) of SEQ ID NO: 6;

(q) the heavy chain variable domain comprises amino acids 26-33 (CDR1), 51-58 (CDR2) and 97-114 (CDR3) of SEQ ID NO: 33 and the light chain variable domain comprises amino acids 27-30 (CDR1), 48-50 (CDR2) and 87-91 (CDR3) of SEQ ID NO: 9;

(r) the heavy chain variable domain comprises amino acids 26-33 (CDR1), 51-58 (CDR2) and 97-114 (CDR3) of SEQ ID NO:33 and the light chain variable domain comprises amino acids 27-30 (CDR1), 48-50 (CDR2) and 87-91 (CDR3) of SEQ ID NO: 7;

(s) the heavy chain variable domain comprises amino acids 26-33 (CDR1), 51-58 (CDR2) and 97-114 (CDR3) of SEQ ID NO: 33 and the light chain variable domain comprises amino acids 27-30 (CDR1), 48-50 (CDR2) and 87-91 (CDR3) of SEQ ID NO: 8;

(t) the heavy chain variable domain comprises amino acids 26-33 (CDR1), 51-58 (CDR2) and 97-114 (CDR3) of SEQ ID NO: 33 and the light chain variable domain comprises amino acids 27-30 (CDR1), 48-50 (CDR2) and 87-91 (CDR3) of SEQ ID NO: 27;

(v) the heavy chain variable domain comprises amino acids 26-33 (CDR1), 51-58 (CDR2) and 97-114 (CDR3) of SEQ ID NO: 34, and the light chain variable domain comprises amino acids 27-30 (CDR1), 48-50 (CDR2) and 87-91 (CDR3) of SEQ ID NO: 6;

(w) the heavy chain variable domain comprises amino acids 26-33 (CDR1), 51-58 (CDR2) and 97-114 (CDR3) of SEQ ID NO: 34 and the light chain variable domain comprises amino acids 27-30 (CDR1), 48-50 (CDR2) and 87-91 (CDR3) of SEQ ID NO: 9;

(x) the heavy chain variable domain comprises amino acids 26-33 (CDR1), 51-58 (CDR2) and 97-114 (CDR3) of SEQ ID NO:34 and the light chain variable domain comprises amino acids 27-30 (CDR1), 48-50 (CDR2) and 87-91 (CDR3) of SEQ ID NO: 7;

(y) the heavy chain variable domain comprises amino acids 26-33 (CDR1), 51-58 (CDR2) and 97-114 (CDR3) of SEQ ID NO: 34 and the light chain variable domain comprises amino acids 27-30 (CDR1), 48-50 (CDR2) and 87-91 (CDR3) of SEQ ID NO: 8;

(z) the heavy chain variable domain comprises amino acids 26-33 (CDR1), 51-58 (CDR2) and 97-114 (CDR3) of SEQ ID NO: 34 and the light chain variable domain comprises amino acids 27-30 (CDR1), 48-50 (CDR2) and 87-91 (CDR3) of SEQ ID NO: 27;

(aa) the heavy chain variable domain comprises amino acids 26-33 (CDR1), 51-58 (CDR2) and 97-114 (CDR3) of SEQ ID NO: 35, and the light chain variable domain comprises amino acids 27-30 (CDR1), 48-50 (CDR2) and 87-91 (CDR3) of SEQ ID NO: 6;

(bb) the heavy chain variable domain comprises amino acids 26-33 (CDR1), 51-58 (CDR2) and 97-114 (CDR3) of SEQ ID NO: 35 and the light chain variable domain comprises amino acids 27-30 (CDR1), 48-50 (CDR2) and 87-91 (CDR3) of SEQ ID NO: 9;

(cc) the heavy chain variable domain comprises amino acids 26-33 (CDR1), 51-58 (CDR2) and 97-114 (CDR3) of SEQ ID NO:35 and the light chain variable domain comprises amino acids 27-30 (CDR1), 48-50 (CDR2) and 87-91 (CDR3) of SEQ ID NO: 7;

(dd) the heavy chain variable domain comprises amino acids 26-33 (CDR1), 51-58 (CDR2) and 97-114 (CDR3) of SEQ ID NO: 35 and the light chain variable domain comprises amino acids 27-30 (CDR1), 48-50 (CDR2) and 87-91 (CDR3) of SEQ ID NO: 8;

(ee) the heavy chain variable domain comprises amino acids 26-33 (CDR1), 51-58 (CDR2) and 97-114 (CDR3) of SEQ ID NO: 35 and the light chain variable domain comprises amino acids 27-30 (CDR1), 48-50 (CDR2) and 87-91 (CDR3) of SEQ ID NO: 27;

(ff) the heavy chain variable domain comprises amino acids 26-33 (CDR1), 51-58 (CDR2) and 97-114 (CDR3) of SEQ ID NO: 36, and the light chain variable domain comprises amino acids 27-30 (CDR1), 48-50 (CDR2) and 87-91 (CDR3) of SEQ ID NO: 6;

(gg) the heavy chain variable domain comprises amino acids 26-33 (CDR1), 51-58 (CDR2) and 97-114 (CDR3) of SEQ ID NO: 36 and the light chain variable domain comprises amino acids 27-30 (CDR1), 48-50 (CDR2) and 87-91 (CDR3) of SEQ ID NO: 9;

(hh) the heavy chain variable domain comprises amino acids 26-33 (CDR1), 51-58 (CDR2) and 97-114 (CDR3) of SEQ ID NO:36 and the light chain variable domain comprises amino acids 27-30 (CDR1), 48-50 (CDR2) and 87-91 (CDR3) of SEQ ID NO: 7;

(ii) the heavy chain variable domain comprises amino acids 26-33 (CDR1), 51-58 (CDR2) and 97-114 (CDR3) of SEQ ID NO: 36 and the light chain variable domain comprises amino acids 27-30 (CDR1), 48-50 (CDR2) and 87-91 (CDR3) of SEQ ID NO: 8; or (jj) the heavy chain variable domain comprises amino acids 26-33 (CDR1), 51-58 (CDR2) and 97-114 (CDR3) of SEQ ID NO: 37 and the light chain variable domain comprises amino acids 27-30 (CDR1), 48-50 (CDR2) and 87-91 (CDR3) of SEQ ID NO: 27.

Clause 27. The isolated monoclonal antibody of any one of clauses 7-9 or 22, wherein the isolated monoclonal antibody has reduced autoreactivity as compared to a monoclonal antibody that includes a heavy chain variable domain that comprises amino acids 26-33 (CDR1), 51-58 (CDR2) and/or 97-114 (CDR3) of SEQ ID NO: 2, and includes a light chain variable domain comprising amino acids 27-30 (CDR1), 48-50 (CDR2) and/or 87-91 (CDR3) of SEQ ID NO: 6, wherein an antibody that includes the heavy chain variable domain specifically binds gp120 of HIV-1, and wherein the antibody is neutralizing.

Clause 28. The isolated monoclonal antibody of clauses 10-12, wherein (a) the heavy chain variable domain comprises amino acids 26-33 (CDR1), 51-58 (CDR2) and 97-114 (CDR3) of SEQ ID NO: 38, and the light chain variable domain comprises amino acids 27-30 (CDR1), 48-50 (CDR2) and 87-91 (CDR3) of SEQ ID NO: 6;

(b) the heavy chain variable domain comprises amino acids 26-33 (CDR1), 51-58 (CDR2) and 97-114 (CDR3) of SEQ ID NO: 38 and the light chain variable domain comprises amino acids 27-30 (CDR1), 48-50 (CDR2) and 87-91 (CDR3) of SEQ ID NO: 9;

(c) the heavy chain variable domain comprises amino acids 26-33 (CDR1), 51-58 (CDR2) and 97-114 (CDR3) of SEQ ID NO:38 and the light chain variable domain comprises amino acids 27-30 (CDR1), 48-50 (CDR2) and 87-91 (CDR3) of SEQ ID NO: 7;

(d) the heavy chain variable domain comprises amino acids 26-33 (CDR1), 51-58 (CDR2) and 97-114 (CDR3) of SEQ ID NO: 38 and the light chain variable domain comprises amino acids 27-30 (CDR1), 48-50 (CDR2) and 87-91 (CDR3) of SEQ ID NO: 8;

(e) the heavy chain variable domain comprises amino acids 26-33 (CDR1), 51-58 (CDR2) and 97-114 (CDR3) of SEQ ID NO: 38 and the light chain variable domain comprises amino acids 27-30 (CDR1), 48-50 (CDR2) and 87-91 (CDR3) of SEQ ID NO: 27;

(f) the heavy chain variable domain comprises amino acids 26-33 (CDR1), 51-58 (CDR2) and 97-114 (CDR3) of SEQ ID NO: 39, and the light chain variable domain comprises amino acids 27-30 (CDR1), 48-50 (CDR2) and 87-91 (CDR3) of SEQ ID NO: 6;

(g) the heavy chain variable domain comprises amino acids 26-33 (CDR1), 51-58 (CDR2) and 97-114 (CDR3) of SEQ ID NO: 39 and the light chain variable domain comprises amino acids 27-30 (CDR1), 48-50 (CDR2) and 87-91 (CDR3) of SEQ ID NO: 9;

(h) the heavy chain variable domain comprises amino acids 26-33 (CDR1), 51-58 (CDR2) and 97-114 (CDR3) of SEQ ID NO: 39 and the light chain variable domain comprises amino acids 27-30 (CDR1), 48-50 (CDR2) and 87-91 (CDR3) of SEQ ID NO: 7;

(i) the heavy chain variable domain comprises amino acids 26-33 (CDR1), 51-58 (CDR2) and 97-114 (CDR3) of SEQ ID NO: 39 and the light chain variable domain comprises amino acids 27-30 (CDR1), 48-50 (CDR2) and 87-91 (CDR3) of SEQ ID NO: 8;

(j) the heavy chain variable domain comprises amino acids 26-33 (CDR1), 51-58 (CDR2) and 97-114 (CDR3) of SEQ ID NO: 39 and the light chain variable domain comprises amino acids 27-30 (CDR1), 48-50 (CDR2) and 87-91 (CDR3) of SEQ ID NO: 27;

Clause 29. An isolated monoclonal antibody, comprising a heavy chain variable domain and a light chain variable domain, wherein the heavy chain variable domain of the antibody comprises amino acids 26-33 (CDR1), 51-58 (CDR2) and/or 97-114 (CDR3) of SEQ ID NO: 40, wherein the antibody specifically binds gp120 of HIV-1, and wherein the antibody is neutralizing.

Clause 30. The isolated human monoclonal antibody of claim 3, wherein the heavy chain domain of the antibody comprises amino acids 26-33 (CDR1), 51-58 (CDR2) and 97-114 (CDR3) of SEQ ID NO: 40.

Clause 31. The isolated monoclonal antibody of claim 1, wherein the heavy chain variable domain comprises one of:

(a) amino acids 26-33 (CDR1), 51-58 (CDR2) and/or 97-114 (CDR3) of SEQ ID NO: 40, wherein $X_1$ is I, $X_2$ is H, $X_3$ is S and $X_4$ is T; or (b) amino acids 26-33 (CDR1), 51-58 (CDR2) and/or 97-114 (CDR3) of SEQ ID NO: 40, wherein $X_1$ is I, $X_2$ is H, $X_3$ is N and $X_4$ is T.

Clause 32. The isolated monoclonal antibody of claim 1, wherein the heavy chain variable domain comprises one of:

(a) amino acids 26-33 (CDR1), 51-58 (CDR2) and 97-114 (CDR3) of SEQ ID NO: 40, wherein $X_1$ is I, $X_2$ is H, $X_3$ is S and $X_4$ is T; or (b) amino acids 26-33 (CDR1), 51-58 (CDR2) and 97-114 (CDR3) of SEQ ID NO: 40, wherein $X_1$ is I, $X_2$ is H, $X_3$ is N and $X_4$ is T.

Clause 33. The isolated monoclonal antibody of any one of claims 1-4, wherein the heavy chain variable domain of the antibody comprises SEQ ID NO: 40.

Clause 34. The isolated monoclonal antibody of any one of claims 1-5, wherein the heavy chain variable domain of the antibody comprises one of:

(a) SEQ ID NO: 40, wherein $X_1$ is I, $X_2$ is H, $X_3$ is S and $X_4$ is T;

(b) SEQ ID NO: 40, wherein $X_1$ is I, $X_2$ is H, $X_3$ is N and $X_4$ is T;

(c) SEQ ID NO: 40, wherein $X_1$ is V, $X_2$ is H, $X_3$ is S and $X_4$ is A; or (d) SEQ ID NO: 40, wherein $X_1$ is V, $X_2$ is H, $X_3$ is N and $X_4$ is A.

Clause 35. The isolated monoclonal antibody of any one of claims 1-18, wherein the light chain variable domain of the antibody comprises amino acids 27-30 (CDR1), 48-50 (CDR2) and 87-91 (CDR3) of SEQ ID NO: 41, wherein $X_1$ is E or no amino acid, $X_2$ is I or no amino acid, wherein $X_3$ is T or I, $X_4$ is W or S, $X_5$ is N or T, $X_6$ is V or Q, and $X_7$ is I or N.

Clause 36. The isolated monoclonal antibody of any one of claims 1-7, wherein the light chain variable domain of the antibody comprises one of:

(a) SEQ ID NO: 41, wherein $X_1$ is E, $X_2$ is I, $X_3$ is I, $X_4$ is W, $X_5$ is N, $X_6$ is V, and $X_7$ is I (b) SEQ ID NO: 41, wherein $X_1$ is no amino acid, $X_2$ is no amino acid, $X_3$ is I, $X_4$ is W, $X_5$ is N, $X_6$ is V, and $X_7$ is I (c) SEQ ID NO: 41, wherein $X_1$ is no amino acid, $X_2$ is no amino acid, $X_3$ is I, $X_4$ is W, $X_5$ is T, $X_6$ is V, and $X_7$ is I;

(d) SEQ ID NO: 41, wherein $X_1$ is E, $X_2$ is I, $X_3$ is T, $X_4$ is 5, $X_5$ is T, $X_6$ is Q, and $X_7$ is N;

(e) SEQ ID NO: 41, wherein $X_1$ is E, $X_2$ is no amino acid, $X_3$ is T, $X_4$ is 5, $X_5$ is T, $X_6$ is Q, and $X_7$ is N;

(f) SEQ ID NO: 42;

(g) SEQ ID NO: 43; or (h) SEQ ID NO: 44.

Clause 37. The isolated monoclonal antibody of any of clauses 1-36, wherein the antibody is an IgG, IgM or IgA.

Clause 38. The isolated monoclonal antibody of any one of clauses 1-36, wherein the antibody is human.

Clause 39. An isolated antigen binding fragment of the isolated monoclonal antibody of any of clauses 1-38.

Clause 40. The isolated antigen binding fragment of clause 39, wherein the fragment is a Fab fragment, a Fab' fragment, a F(ab)'$_2$ fragment, a single chain Fv protein (scFv), or a disulfide stabilized Fv protein (dsFv).

Clause 41. The isolated antigen binding fragment of clause 40, wherein the antigen binding fragment is a Fab or an scFv fragment.

Clause 42. The isolated monoclonal antibody of any of clauses 1-41, or an antigen binding fragment thereof, wherein the antibody or antigen binding fragment is labeled.

Clause 43. The isolated monoclonal antibody or antigen binding fragment of clause 42, wherein the label is a fluorescent, enzymatic, or radioactive label.

Clause 44. A composition comprising a therapeutically effective amount of the antibody of clauses 1-38, or an antigen binding fragment thereof, and a pharmaceutically acceptable carrier.

Clause 45. An isolated nucleic acid molecule encoding the monoclonal antibody of any of clauses 1-38 or encoding an antigen binding fragment of the monoclonal antibody.

Clause 46. The isolated nucleic acid molecule of clause 32, comprising a nucleic acid sequence set forth as SEQ ID NO: 11-16 or 37, a nucleic acid sequence set forth in Table 2 or Table 3, or a portion thereof.

Clause 47. The isolated nucleic acid molecule of one of clause 45 or clause 46, operably linked to a promoter.

Clause 48. An expression vector comprising the isolated nucleic acid molecule of any one of clauses 45-47.

Clause 49. An isolated host cell transformed with the nucleic acid molecule or vector of any one of clauses 45-48.

Clause 50. A method of detecting a human immunodeficiency virus (HIV)-1 infection in a subject comprising:

contacting a biological sample from the subject with at least one isolated monoclonal antibody of clauses 1-37 or an antigen binding fragment thereof; and detecting antibody bound to the sample, wherein the presence of antibody bound to the sample indicates that the subject has an HIV-1 infection.

Clause 51. The method of clause 50, wherein the isolated human monoclonal antibody is directly labeled.

Clause 52. The method of clause 50 or 51, further comprising:

contacting the sample with a second antibody that specifically binds the isolated human monoclonal antibody; and detecting the binding of the second antibody, wherein an increase in binding of the second antibody to the sample as compared to binding of the second antibody to a control sample detects the presence of an HIV-1 infection the subject.

Clause 53. A method for preventing or treating an human immunodeficiency virus (HIV)-1 infection in a subject, comprising administering to the subject a therapeutically effective amount of at least one antibody of any one of clauses 1-38, an antigen binding fragment thereof, a nucleic acid encoding the antibody, and/or a nucleic acid encoding the antigen binding fragment, thereby preventing or treating the HIV-1 infection.

Clause 54. The method of clause 53, wherein the method is a method for treating an HIV-1 infection, and wherein the subject has acquired immune deficiency syndrome (AIDS).

Clause 55. The method of clause 53 or 54, further comprising administering to the subject an anti-viral agent.

Clause 56. The method of any one of clauses 53-55, further comprising measuring HIV-1 viral titer in the subject.

Clause 57. A composition comprising a therapeutically effective amount of the nucleic acid of clauses 44-47, or the vector of clause 48 and a pharmaceutically acceptable carrier.

The following examples are provided to illustrate certain particular features and/or embodiments. These examples should not be construed to limit the disclosure to the particular features or embodiments described.

EXAMPLES

Example 1

Summary of Methods and Results

1. The Identification of VRC07.

VRC01 was cloned from patient 45, a treatment naïve slow progressor from North America. It was hypothesized that this patient's blood could contain related but more potent antibodies. To further explore the antibodyome, deep sequencing (454 pyrosequencing) was used to amplify and analyze the variable domains of both heavy and light chains of Immunoglobulin G (IgG). VRC07 heavy chain was identified, which appeared to be a clonal-relative of VRC01 but differed by 16 amino acids and contained a 4 amino acid insertion in the CDRH3. The natural light chain of VRC07 was not known, as heavy and light chains were sequenced en masse from peripheral blood mononuclear cells (PBMCs). Thus, VRC07 was tested paired with the VRC01 light chain. Initial neutralization screening showed VRC07 was more potent than VRC01 and was able to neutralize a number of VRC01-resistant strains. On a 181 virus screen that included a set of 18 VRC01 resistant viruses, VRC07 was able to neutralize 91% of viruses with an $IC_{50}$ less than 50 µg/ml and 72% of viruses with in $IC_{50}$ less than 1 µg/ml. VRC07 had a mean $IC_{50}$ of 0.11 µg/ml, a 2.8-fold improvement over its predecessor, and was able to neutralize a number of VRC01-resistant strains.

2. Rational Structure-Based Optimizations.

Initial Optimizations: Increasing Contact Area with Gp120.

Although VRC07 wildtype was highly potent and represented a significant increase above VRC01, studies were then performed to engineer VRC07 to have at least a 10-fold improvement in neutralization potential over VRC01. Biochemical and structure/function approaches were both used to improve VRC07.

Alanine screening of all gp120 contact residues revealed one clear hot spot: mutation of heavy chain Gly54 to Ala resulted in a 7-fold increase in binding to gp120. A large, hydrophobic or charged residue (Arg, Trp, Phe, Tyr) was substituted into position $54_{HC}$ in VRC07. All increased neutralization breadth and potency, and the $Gly54_{HC}Trp$ mutation increased neutralization potency by 4.8 fold over VRC07 (~13-fold increase over VRC01). Diskin et al. (*Science* 2011) found a $Gly54_{HC}Trp$ mutation in a VRC01-related antibody (NIH4546) increased potency ~10-fold. Replacing Gly with a larger, hydrophobic residue allows the CDRH2 of the antibody to enter into a cavity on gp120, increasing the overall contact area between the molecules and thus increasing the strength of the overall interaction.

For administration to humans, antibodies should not be auto-reactive (i.e., not bind to human antigens). A number of assays are available to test for auto-reactivity in vitro, including an ELISA-based anti-cardiolipin assay, a Luminex-based anti-nuclear antigen (ANA) assay, and an ANA cell-staining assay, which is considered the gold standard. Unfortunately, VRC07 $Gly54_{HC}Trp$ proved to be highly auto-reactive in all three assays. In fact, all four tested $G54_{HC}$ variants (Trp, Arg, Tyr, Phe) were highly auto-reactive, indicating that these were not preferred for human use, but could be used as diagnostics.

Additional Structure-Guided Heavy Chain Optimizations.

First, the structure of VRC07 in complex with gp120 was solved. The structures of VRC01, VRC07, and the biochemical data from alanine screening were used to identify key resides for experimental manipulation.

Because of the potential importance of position $54_{HC}$ in increasing contact area with gp120, it was decided to fully saturate this residue and test every possible amino acid substitution. Since it had been determined that a number of $G54_{HC}$ resides were highly auto-reactive (see above), each resulting antibody was screened for auto-reactivity. A His at position 54 increased neutralization by ~2.5 fold over VRC07 (~7-fold over VRC01) and was not auto-reactive in initial analyses.

Position 58 in the heavy chain was also of interest. In initial analyses, mutation of $Ser58_{HC}$ to Asn increased neutralization potential by 1.5 fold (~4.2 over VRC01). In VRC01, VRC03, and NIH4546 (all clonal relatives of VRC01 and VRC07) residue $58_{HC}$ is an Asn, but in VRC07 position $58_{HC}$ is a Ser.

Light Chain Structure-Guided Optimizations:

N-terminal modifications. An alanine screen of the light chain gp120-contact residues showed that mutating $Val3_{LC}$ to Ala resulted in a 4-fold increase in binding. Additionally, the solved crystal structures of VRC01 and VRC07 lacked resolution of the N-terminal most 2 residues (VRC01) or 1 residue (VRC07) of the light chain, suggesting these residues do not make critical contact within the antibody or with gp120. The $NH_2$-terminal domain of VRC01 light chain was modified, including deletions and Ala and Gly substitutions of amino acids $\#1_{LC}$-$4_{LC}$. A two amino acid deletion resulted in an increased potency of ~2.5-fold (~7 fold increase over VRC01).

3. Additional Optimizations.

Germline reversions to reduce immunogenicity. VRC01, VRC07, and related antibodies are highly somatically mutated. It was determined that VRC07 could be reverted towards its germline while maintaining potency and breadth. Reducing somatic mutations may reduce the in vivo immunogenicity of the molecules. The somatic mutations were reduced by one half (44% to 22%) in the heavy chain and one third (29% to 19%) in the light chain and mature residues were iteratively added back. All back mutations were in the framework regions. Most germline reversions were able to maintain basic functions, such as gp120 binding, although they were not as potent and/or broad as the mature VRC07. Interestingly, three germline mutations were identified in the heavy chain ($Arg3_{HC}$Gln, $Ile37_{HC}$Val, $Thr93_{HC}$Ala) that increased potency by 1.2-fold (~3.3 fold over VRC01). It is of note that $Ser58_{HC}$Asn, which increases potency by ~1.5-fold, is also a germline reversion mutation.

Light/Heavy Interface Optimizations.

Strengthening the interactions between the light and heavy chains can increase the stability of the molecule, which may increase neutralization potency. Using rational structure-based design and bioinformatic approaches, four light chain mutants were designed to increase binding with the heavy chain. While these light chains increased neutralization potency, they were auto-reactive, and were not developed. This demonstrates that it is often not predictable which rational design and bioinformatics approaches will be successful.

Optimization of Solubility and Elimination of Glycans.

In addition to mutations designed solely to increase neutralization potential, parameters were optimized that affect large-scale protein production. Two areas were addressed: increasing solubility and decreasing glycans. Glycosylation leads to more heterogeneous products, which while not necessarily detrimental to production, does complicate purity analysis. Surprisingly, it was found that deleting the N-linked glycosylation site at position $72_{LC}$ ($Asn72_{LC}$Thr mutation) on the light chain increased potency 1.2-fold. The solubility mutant light chain (VRC01hpL02), which contained 4 mutated residues on solvent exposed surfaces (hydrophobic to hydrophilic mutations) and the same deletion of the N-linked glycosylation site at position $72_{LC}$, also increased neutralization ~1.2-fold (~3.3 fold over VRC01).

Mutations to Increase Half-Life.

In order to optimize in vivo half-life, an LS mutation to was added to the FcRn receptor binding region (Zalevsky, et al., *Nature Biotechnology* 2010). This mutation has no effect on neutralization breadth or potency, but increases the half-life of the antibody by 2- to 3-fold in both humanized mice and non-human primates.

4. Combining mutations.

Over 200 engineered VRC07 variants have been tested. Most were analyzed for neutralization potential on panels of 6-12 viruses and a subset were tested for auto-reactivity. Based on these results, four heavy chains and five light chains were identified as being of specific interest. For the heavy chains, combinations of the $Ser58_{HC}$Asn mutation, two germline mutations ($Ile37_{HC}$Val and $Thr93_{HC}$Ala), and the $Gly54_{HC}$His mutation were identified. A combination of these mutations can increase potency up to 4.5-fold over the VRC07 wild type (~12.5-fold over VRC01).

Additionally, mutations have been combined on the light chain, including combinations of the substitutions at position of $Phe97_{LC}$, solubility substitutions (VRC01hpL02, VRC01hpL03, VRC01hpL04, VRC01hpL05), VRC01hpL06) and glycan mutants ($Asn72_{LC}$Thr) with the N-terminal modifications (deletion of $Glu1_{LC}$, $Ile3_{LC}$, substitution of $Val3_{LC}$). These mutations can contribute a 3-fold increase in potency (~8.5-fold increase over VRC01).

A combination can yield see an increase of ~5-fold over the parental VRC07, which is an increase of ~15-fold over VRC01. The VRC07 heavy chains are:

1. VRC07 G54H:
(SEQ ID NO: 32)
QVRLSQSGGQMKKPGDSMRISCRASGYEFINCPINWIRLAPGKRPEWMGW

MKPRHGAVSYARQLQGRVTMTRDMYSETAFLELRSLTSDDTAVYFCTRGK

YCTARDYYNWDFEHWGQGTPVTVSS

2. VRC07 G54H, S58N:
(SEQ ID NO: 258)
QVRLSQSGGQMKKPGDSMRISCRASGYEFINCPINWIRLAPGKRPEWMGW

MKPRHGAVNYARQLQGRVTMTRDMYSETAFLELRSLTSDDTAVYFCTRGK

YCTARDYYNWDFEHWGQGTPVTVSS

3. VRC07 I37V, G54H, T93A:
(SEQ ID NO: 259)
QVRLSQSGGQMKKPGDSMRISCRASGYEFINCPINWVRLAPGKRPEWMGW

MKPRHGAVSYARQLQGRVTMTRDMYSETAFLELRSLTSDDTAVYFCARGK

YCTARDYYNWDFEHWGQGTPVTVSS

4. VRC07 I37V, G54H, S58N, T93A:
(SEQ ID NO: 260)
QVRLSQSGGQMKKPGDSMRISCRASGYEFINCPINWVRLAPGKRPEWMGW

MKPRHGAVNYARQLQGRVTMTRDMYSETAFLELRSLTSDDTAVYFCARGK

YCTARDYYNWDFEHWGQGTPVTVSS

The light chain variable domains for pairing with the VRC07 heavy chain include:

1. VRC01:
(SEQ ID NO: 9)
EIVLTQSPGTLSLSPGETAIISCRTSQYGSLAWYQQRPGQAPRLVIYSGS

TRAAGIPDRFSGSRWGPDYNLTISNLESGDFGVYYCQQYEFFGQGTKVQV

DIK

2. VRC01 E1/I2del V3E:
(SEQ ID NO: 219)
ELTQSPGTLSLSPGETAIISCRTSQYGSLAWYQQRPGQAPRLVIYSGSTR

AAGIPDRFSGSRWGPDYNLTISNLESGDFGVYYCQQYEFFGQGTKVQVDI

K

3. VRC01 E1/I2del V3K:
(SEQ ID NO: 220)
KLTQSPGTLSLSPGETAIISCRTSQYGSLAWYQQRPGQAPRLVIYSGSTR

AAGIPDRFSGSRWGPDYNLTISNLESGDFGVYYCQQYEFFGQGTKVQVDI

K

4. VRC01 E1/I2del V3S:
(SEQ ID NO: 221)
SLTQSPGTLSLSPGETAIISCRTSQYGSLAWYQQRPGQAPRLVIYSGSTR

AAGIPDRFSGSRWGPDYNLTISNLESGDFGVYYCQQYEFFGQGTKVQVDI

K

5. VRC01 E1/I2del F97D:
(SEQ ID NO: 222)
VLTQSPGTLSLSPGETAIISCRTSQYGSLAWYQQRPGQAPRLVIYSGSTR

AAGIPDRFSGSRWGPDYNLTISNLESGDFGVYYCQQYEDFGQGTKVQVDI

K

6. VRC01 E1/I2del F97K:
(SEQ ID NO: 223)
VLTQSPGTLSLSPGETAIISCRTSQYGSLAWYQQRPGQAPRLVIYSGSTR

AAGIPDRFSGSRWGPDYNLTISNLESGDFGVYYCQQYEKFGQGTKVQVDI

K

7. VRC01 E1/I2del F97S:
(SEQ ID NO: 224)
VLTQSPGTLSLSPGETAIISCRTSQYGSLAWYQQRPGQAPRLVIYSGSTR

AAGIPDRFSGSRWGPDYNLTISNLESGDFGVYYCQQYESFGQGTKVQVDI

K

8. VRC01 E1/I2del F97H:
(SEQ ID NO: 225)
VLTQSPGTLSLSPGETAIISCRTSQYGSLAWYQQRPGQAPRLVIYSGSTR

AAGIPDRFSGSRWGPDYNLTISNLESGDFGVYYCQQYEHFGQGTKVQVDI

K

9. VRC01 E1/I2del V3E, F97S:
(SEQ ID NO: 226)
ELTQSPGTLSLSPGETAIISCRTSQYGSLAWYQQRPGQAPRLVIYSGSTR

AAGIPDRFSGSRWGPDYNLTISNLESGDFGVYYCQQYESFGQGTKVQVDI

K

10. VRC01 E1/I2del V3E, F97H:
(SEQ ID NO: 227)
ELTQSPGTLSLSPGETAIISCRTSQYGSLAWYQQRPGQAPRLVIYSGSTR

AAGIPDRFSGSRWGPDYNLTISNLESGDFGVYYCQQYEHFGQGTKVQVDI

K

11. VRC01hpL03:
(SEQ ID NO: 228)
EIVLTQSPGTLSLSPGETAIISCRTSQYGSLAWYQQRPGQAPRLVIYSGS

TRAAGIPDRFSGSRSGPDYTLTISNLESGDFGVYYCQQYEFFGQGTKVQV

DIK

12. VRC01hpL04:
(SEQ ID NO: 229)
EIVLTQSPGTLSLSPGETAQISCRTSQYGSLAWYQQRPGQAPRLVIYSGS

TRAAGIPDRFSGSRNGPDYTLTISNLESGDFGVYYCQQYEFFGQGTKVQV

DIK

13. VRC01hpL05:
(SEQ ID NO: 230)
EIVLTQSPGTLSLSPGETAQISCRTSQYGSLAWYQQRPGQAPRLVIYSGS

TRAAGIPDRFSGSRNGPDYTLTISNLESGDFGVYYCQQYEFFGQGTKVQQ

DNK

14. VRC01hpL06:
(SEQ ID NO: 231)
EIVLTQSPGTLSLSPGETAEISCRTSQYGSLAWYQQRPGQAPRLVIYSGS

TRAAGIPDRFKGEREGPEYRLRISNLESGDFGVYYCQQYEFFGQGTKVQQ

DNK

15. VRC01hpL02 E1/I2-deletion, V3S:
(SEQ ID NO: 232)
SLTQSPGTLSLSPGETATISCRTSQYGSLAWYQQRPGQAPRLVIYSGSTR

AAGIPDRFSGSRSGPDYTLTISNLESGDFGVYYCQQYEFFGQGTKVQQDN

K

16. VRC01LhpL03 E1/I2-deletion, V3S:
(SEQ ID NO: 233)
SLTQSPGTLSLSPGETAIISCRTSQYGSLAWYQQRPGQAPRLVIYSGSTR

AAGIPDRFSGSRSGPDYTLTISNLESGDFGVYYCQQYEFFGQGTKVQVDI

K

17. VRC01LhpL04 E1/I2-deletion, V3S:
(SEQ ID NO: 234)
SLTQSPGTLSLSPGETAQISCRTSQYGSLAWYQQRPGQAPRLVIYSGSTR

AAGIPDRFSGSRNGPDYTLTISNLESGDFGVYYCQQYEFFGQGTKVQVDI

K

18. VRC01LhpL05 E1/I2 deletion, V3S:
(SEQ ID NO: 235)
SLTQSPGTLSLSPGETAQISCRTSQYGSLAWYQQRPGQAPRLVIYSGSTR

AAGIPDRFSGSRNGPDYTLTISNLESGDFGVYYCQQYEFFGQGTKVQQDN

K

-continued

19. VRC01LhpL06 E1/I2-deletion, V3S:
(SEQ ID NO: 236)
SLTQSPGTLSLSPGETAEISCRTSQYGSLAWYQQRPGQAPRLVIYSGSTR

AAGIPDRFKGEREGPEYRLRISNLESGDFGVYYCQQYEFFGQGTKVQQDN

K

20. VRC01LhpL04 E1/I2-deletion, V3E:
(SEQ ID NO: 237)
ELTQSPGTLSLSPGETAQISCRTSQYGSLAWYQQRPGQAPRLVIYSGSTR

AAGIPDRFSGSRNGPDYTLTISNLESGDFGVYYCQQYEFFGQGTKVQVDI

K

21. VRC01 E1/I2 deletion:
(SEQ ID NO: 53)
VLTQSPGTLSLSPGETAIISCRTSQYGSLAWYQQRPGQAPRLVIYSGSTR

AAGIPDRFSGSRWGPDYNLTISNLESGDFGVYYCQQYEFFGQGTKVQVDI

K

22. VRC01hpL02:
(SEQ ID NO: 50)
EIVLTQSPGTLSLSPGETATISCRTSQYGSLAWYQQRPGQAPRLVIYSGS

TRAAGIPDRFSGSRSGPDYTLTISNLESGDFGVYYCQQYEFFGQGTKVQQ

DNK

Thus, rational, structure/function-based designs were used to engineer antibodies that are 10-fold more potent than VRC01. A combination of binding mutations and germline reversions increases heavy chain potency, such as by up to 4.5-fold over VRC07. $NH_2$-terminal modifications coupled with glycan deletions and solubility mutations increase light chain potency by 3-fold over VRC07. Since VRC07 is 2.8 fold more potent than VRC01, this can result in more than a 10-fold threshold for an increase over VRC01 potency (a 38-fold calculated).

Many manipulations of antibodies result in auto-reactivity. In general, it was found that many of the most potent modifications including $Gly54_{HC}Trp$ and light-heavy interface mutations result in auto-reactivity. There is no established method to predict auto-reactivity by bioinformatics, so auto-reactivity must be determined empirically. An antibody with increased auto-reactivity can be used in diagnostic assays, but likely will not be used as a therapeutic.

All antibodies can be tested in three auto-reactivity assays early in development. The predicted increases in potency discussed above include mutations shown not to be auto-reactive. The disclosed antibodies can be used in combination with other antibodies, in order to increase potency and breadth, hence efficacy, while minimizing the possibility of virus escape.

Example 2

Identification of Human Monoclonal HIV-1 Gp120 Specific Neutralizing Antibodies

The following methods were used to isolate VRC07, VRC07b, and VRC07c human monoclonal antibodies (See FIGS. 1-5). The heavy chain of the VRC07 antibody and the heavy and light chains of the VRC07b and VRC07c antibodies were isolated.

As described in the following methods, the potency and breadth of neutralization of the VRC07 antibody (VRC07 heavy chain (SEQ ID NO: 2) paired with VRC01 light chain (SEQ ID NO: 9) and a IgG constant domain) was assessed on a comprehensive panel of Env pseudoviruses (see FIGS. 6 and 7). These 190 viral strains represented all major circulating HIV-1 genetic subtypes (clades) and included viruses derived from acute and chronic stages of HIV-1 infection. As shown in FIG. 7, VRC07 neutralized 92% of these pseudoviruses with a geometric mean IC50 value of 0.114 µg/ml.

Materials and Methods

Human Specimens.

Peripheral blood mononuclear cells (PBMCs) of donor 45, from whom monoclonal antibodies (mAbs) VRC01, VRC02, VRC03 were isolated, were infected with an HIV-1 Glade B virus. The donor has been HIV-1 infected with a Glade B virus for more than 15 years and is a slow progressor with CD4 T-cell counts over 500 cells/µl, plasma HIV-1 RNA values less than 15,000 copies/ml. He has been chronically infected and had not initiated antiretroviral treatment at the time of PBMC sampling. All human samples were collected with informed consent under clinical protocols approved by the appropriate institutional review board (IRB).

Sample Preparation for 454 Pyrosequencing.

Briefly, mRNA was extracted from 20 million PBMC into 200 µl of elution buffer (Oligotex kit, Qiagen), then concentrated to 10-30 µl by centrifuging the elution through a 30 kD micron filter (Millipore). The reverse-transcription was performed in one or multiple 35 µl-reactions, each composed of 13 µl of mRNA, 3 µl of $oligo(dT)_{1-2}$-18 (SEQ ID NO: 49) at 0.5 µg/µl (Invitrogen), 7 µl of 5× first strand buffer (Invitrogen), 3 µl of RNase Out (Invitrogen), 3 µl of 0.1M DTT, 3 µl of dNTP mix, each at 10 mM, and 3 µl of SuperScript II (Invitrogen). The reactions were incubated at 42° C. for 2 hours. The cDNAs from each sample were combined, cleaned up and eluted in 20 µl of elution buffer (NucleoSpin Extract II kit, Clontech). In this way, 1 µl cDNA was roughly equivalent of transcripts from 1 million PBMC. The immunoglobulin gene-specific PCRs were set up using 5 µl cDNA as template (equivalent of transcripts from 5 million PBMC), using the Platinum Taq DNA Polymerase High Fidelity system (Invitrogen) in a total volume of 50 µl. The reaction mix was composed of water, 5 µl of 10× buffer, 2 µl of dNTP mix, each at 10 mM, 2 µl of $MgSO_4$ at 25 µM, 1 µl of each primer at 25 µM, and 1 µA of platinum Taq DNA polymerase high fidelity. The forward primers for VH1 gene amplification were 5'L-VH1, 5'ACAGGTGCCCACTCCCAGGTGCAG3' (SEQ ID NO: 17); 5'L-VH1#2, 5' GCAGCCACAGGTGCCCACTCC3' (SEQ ID NO: 18); 5'L-VH1-24, 5'CAGCAGCTACAGGCAC-CCACGC3' (SEQ ID NO: 19); 5'L-VH1-69, 5' GGCAGCA-GCTACAGGTGTCCAGTCC3' (SEQ ID NO: 20); the reverse primers were 3'Cγ-CH1, 5' GGGGGAAGAC-CGATGGGCCCTTGGTGG3' (SEQ ID NO: 21), and 3' Cµ-CH1, 5' GGGAATTCTCACAGGAGACGA3' (SEQ ID NO: 22). The PCR was initiated at 95° C. for 2 min, followed by 25 cycles of 95° C. for 30 sec, 58° C. for 30 sec, and 72° C. for 1 min, followed by 72° C. for 10 min. The PCR products at the expected size (450-500 bp) were gel purified (Qiagen), followed by phenol/chloroform extraction.

454 Library Preparation and Pyrosequencing.

PCR products were quantified using Qubit™ (Life Technologies, Carlsbad, Calif.). Following end repair 454 adapters were added by ligation. Library concentrations were determined using the KAPA Biosystems qPCR system (Woburn, Mass.) with 454 standards provided in the KAPA system. 454 pyrosequencing of the PCR products was performed on a GS FLX sequencing instrument (Roche-454 Life Sciences, Bradford, Conn.) using the manufacturer's suggested methods and reagents. Initial image collection was performed on the GS FLX instrument and subsequent signal processing, quality filtering, and generation of nucleotide sequence and quality scores were performed on an off-instrument linux cluster using 454 application software (version 2.5.3). The amplicon quality filtering parameters were adjusted based on the manufacturer's recommendations (Roche-454 Life Sciences Application Brief No. 001-2010). Quality scores were assigned to each nucleotide using methodologies incorporated into the 454 application software to convert flowgram intensity values to Phred-based quality scores. The quality of each run was assessed by analysis of internal control sequences included in the 454 sequencing reagents. Reports were generated for each region of the PicoTiterPlate (PTP) for both the internal controls and the samples.

Bioinformatics Analysis of 454-Pyrosequencing-Determined Antibodyomes.

A general bioinformatics pipeline has been developed to process and analyze 454 pyrosequencing-determined antibodyomes. The information generated in each step of the process was used to characterize the basic features of antibodyomes as well as to identify potential neutralizing antibody sequences for functional validation. Specifically, each sequence read was (1) reformatted and labeled with a unique index number; (2) assigned to variable (V) gene family and allele using IgBLAST, and sequences with E-value>$10^{-3}$ were rejected; (3) compared with the germline V-gene and known VRC01-like antibodies using nucleotide sequences and a global alignment module implemented in CLUSTALW2, which provides the basis for identity/divergence-grid analysis (VRC07 heavy chain sequence was identified from the identity/divergence plot); (4) subjected to a template-based error correction scheme where 454 homopolymer errors in V gene were detected and corrected based on the alignment to germline sequence; (5) translated to amino acid sequence, which was further compared with known VRC01-like antibodies; (6) filtered using characteristic sequence motifs in variable domain sequence such as QVQ (or other possible triplets) at the N-terminus, CAR (or other possible triplets) at the end of V region, WGXG at the end of CDR H3, and VSS (or other possible triplets) at the C-terminus of variable domain. As an optional step, the structural compatibility of a 454-pyrosequencing-derived heavy- or light-chain sequence with known VRC01-like antibody/gp120 complex structures can be evaluated by threading.

Isolation of Antigen-Specific Memory B Cells by Fluorescence Activated Cell Sorting (FACS).

The Avi-tagged RSC3 and RSC3 were expressed, purified, and biotinylated using the biotin ligase Bir A (Avidity, Denver, Colo.). The proteins were then conjugated with the streptavidin-fluorochrome reagents, streptavidin-allophycocyanin (SA-APC) (Invitrogen) for RSC3 and streptavidin-phycoerythrin (SA-PE) (Sigma) for ΔRSC3. About 20 million donor PBMC were stained with RSC3-APC, ΔRSC3-PE, and an antibody cocktail consisting of anti-CD3-APC-Cγ7 (BD Pharmingen), CD8-Qdot705 (VRC), CD19-Qdot585 (VRC), CD20-Pacific Blue (VRC), CD27-APC-AlexaFluor700 (Beckman Coulter), CD14-Qdot800 (VRC), IgG-FITC (BD Pharmingen) and IgM-PE-Cγ5 (BD Pharmingen). In addition, aqua blue (Invitrogen) was used to exclude dead cells. The stained PBMC were washed with PBS, then analyzed and sorted using a modified 3-laser FACSAria cell sorter using the FACSDiva software (BD Biosciences). Single cells with the phenotype of CD3−, CD8−, aqua blue−, CD14−, CD19+, CD20+, IgG+, IgM−, RSC3+ and ΔRSC3− were sorted into 96-well PCR plates containing 20 μl of lysis buffer per well. The lysis buffer contained 0.5 μl of RNase Out (Invitrogen), 5 μl of 5× first strand buffer (Invitrogen), 1.25 μl of 0.1M DTT (Invitrogen) and 0.0625 μl of Igepal (Sigma). The PCR plates with sorted cells were stored at −80° C. The total content of the donor PBMC sample passing through the sorter was saved in FCS files for further analysis with FlowJo software (TreeStar, Cupertino, Calif.). The VRC07b and VRC07c antibodies were isolated using the RSC3+ single B cell sort.

Single B-Cell Immunoglobulin Gene Amplification and Cloning.

The frozen plates with single B-cell RNA were thawed at room temperature, and the reverse-transcription was carried out by adding 3 μl of random hexamers (Gene Link, Hawthorne, N.Y.) at 150 ng/μl, 2 μl of dNTP mix, each at 10 mM, and 1 μl of SuperScript 111 (Invitrogen) into each well. The thermocycle for reverse-transcription was 42° C. for 10 min, 25° C. for 10 min, 50° C. for 60 min and 94° C. for 5 min. The cDNA plates were stored at −20° C., and the IgH, IDκ and Igλ variable domain genes were amplified independently by nested PCR starting from 5 μl of cDNA as template. All PCRs were performed in 96-well PCR plates in a total volume of 50 μl containing water, 5 μl of 10× buffer, 1 μl of dNTP mix, each at 10 mM, 1 μl of MgCl$_2$ at 25 mM (Qiagen, Valencia, Calif.) for $1^{st}$ round PCR or 10 μl× Q-SOLUTION™ (Qiagen) for $2^{nd}$ round PCR, 1 μl of primer or primer mix for each direction at 25 μM, and 0.4 μl of HOTSTAR™ Taq DNA polymerase (Qiagen). Each round of PCR was initiated at 94° C. for 5 min, followed by 50 cycles of 94° C. for 30 sec, 58° C. for IgH and Igκ or 60° C. for Igλ for 30 sec, and 72° C. for 1 min, followed by 72° C. for 10 min. The positive $2^{nd}$ round PCR products were cherry-picked for direct sequencing with both forward and reverse PCR primers. PCR products that gave a productive IgH, Igκ or Igλ rearranged sequence were re-amplified from the $1^{st}$ round PCR using custom primers containing unique restriction digest sites and subsequently cloned into the corresponding Igγ1, Igκ and Igλ expression vectors. The full-length IgG1 was expressed by co-transfection of 293F cells with equal amount of the paired heavy and light chain plasmids, and purified using a recombinant protein-A column (GE Healthcare).

IgG Gene Family Analysis.

The IgG heavy and light chain nucleotide sequences of the variable domain were analyzed with the JOINSOLVER® analysis package (available from the National Institute of Allergy and Infectious Disease, Bethesda, Md.) and IMGT/V-Quest (INTERNATIONAL IMMUNOGENETICS INFORMATION SYSTEM®, Brochet, et al., Nucl. Acids Res., 36:W503-508, 2008)). The VRC mAb $V_K$ gene use was determined by homology to germline genes in the major 2p11.2 IGK locus. The VRC mAb D gene use was determined by homology to genes in the major 14q32.33 IGH locus. A combination of consecutive matching length with a +1/−2.02 scoring algorithm in the context of the V to J distance was applied for determining IGHD alignments and VD and DJ junctions in mutated sequences. Immunoglobulin rearrangements were grouped into classes based upon the VDJ gene use, similarity of replacement and silent mutations and the CDR3 identity.

Antibody Expression and Purification.

Genes encoding the heavy and light chain of the VRC07b and VRC07c and the VRC07 heavy chain were each synthesized and cloned (GeneImmune, Gaithersburg, Md.) into the CMV/R expression vector containing the constant regions of IgG1. The VRC07 heavy chain was paired with the VRC01 light chain. The VRC07b and VRC07c heavy chains were paired with the corresponding VRC07b or VRC07c light chains. Full-length IgGs were produced by transient transfection using 293fectin (Invitrogen, Carlsbad, Calif.) in 293F cells (Invitrogen) maintained in serum-free free-style medium (Invitrogen). Culture supernatants were harvested 5-6 days after transfection, filtered through a 0.22 μm filter, then followed by IgG1 purification using a recombinant protein-A column (GE Healthcare).

Neutralization Assays.

Neutralization assays were performed substantially as previously described (see, e.g., PCT Pub. No. WO2011/038290). Briefly, HIV-1 Env-pseudoviruses were prepared by transfecting 293T cells (6×10$^6$ cells in 50 ml growth medium in a T-175 culture flask) with 10 μg of rev/env expression plasmid and 30 μg of an env-deficient HIV-1 backbone vector (pSG3ΔEnvelope), using Fugene 6 transfection reagents (Invitrogen). Pseudovirus-containing culture supernatants were harvested two days after transfection, filtered (0.45 μm), and stored at −80° C. or in the vapor phase of liquid nitrogen. Neutralization was measured using HIV-1 Env-pseudoviruses to infect TZM-bl cells as described previously (see, e.g., PCT Pub. No. WO2011/038290). Virus was incubated for 30 min at 37° C. with 10 μl of serial diluted antibody in duplicate wells of a 96-well flat bottom culture plate. To keep assay conditions constant, sham media was used in place of antibody in specified control wells. The virus input was set at a multiplicity of infection of approximately 0.01, which generally results in 100,000 to 400,000 relative light units (RLU) in a luciferase assay (Bright Glo, Promega, Madison, Wis.). The antibody concentrations were defined at the point of incubation with virus supernatant. Neutralization curves were fit by nonlinear regression using a 5-parameter hill slope equation. The 50% and 80% inhibitory concentrations (IC50 and IC80) were reported as the antibody concentrations required to inhibit infection by 50% and 80% respectively.

Example 3

Optimization of Gp120 Specific Monoclonal Antibodies

Figure 1B:
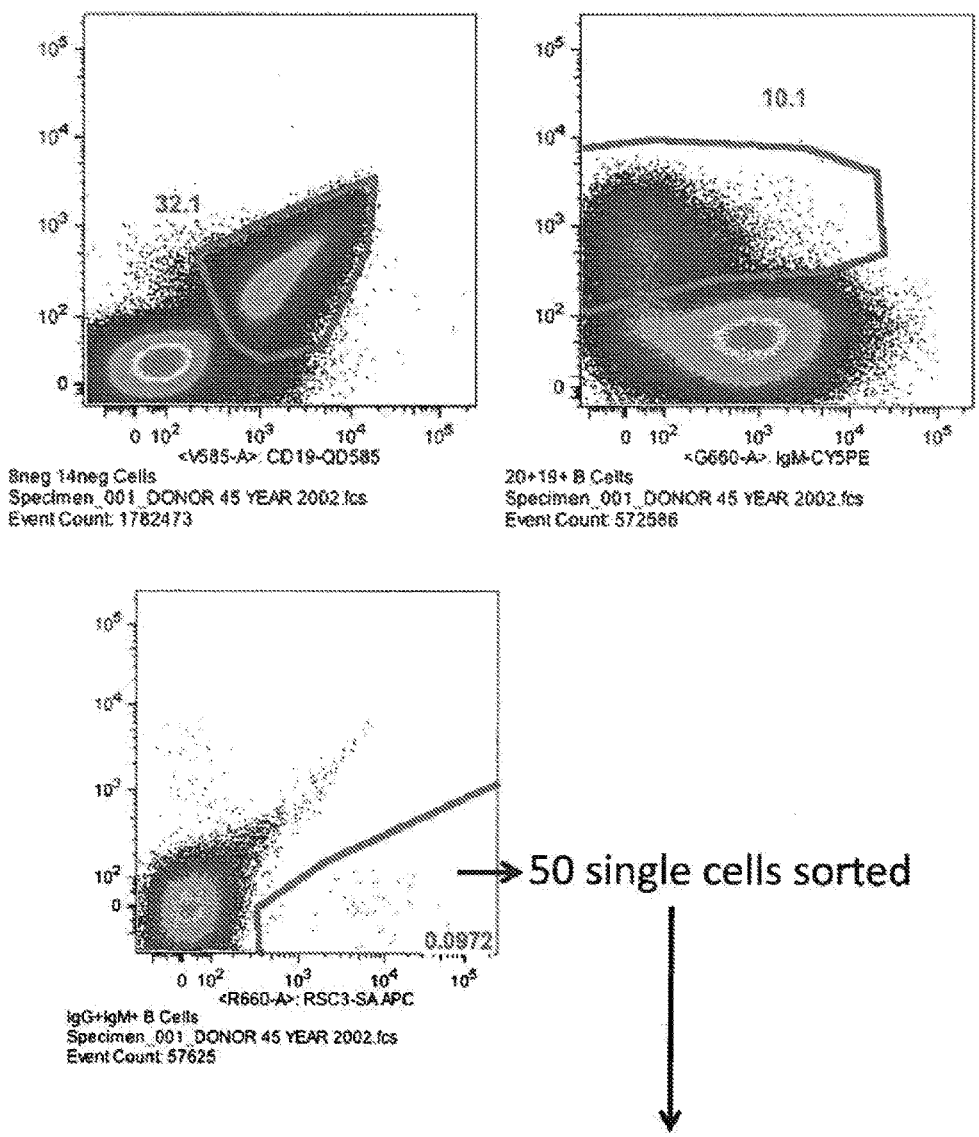
Figure 10:
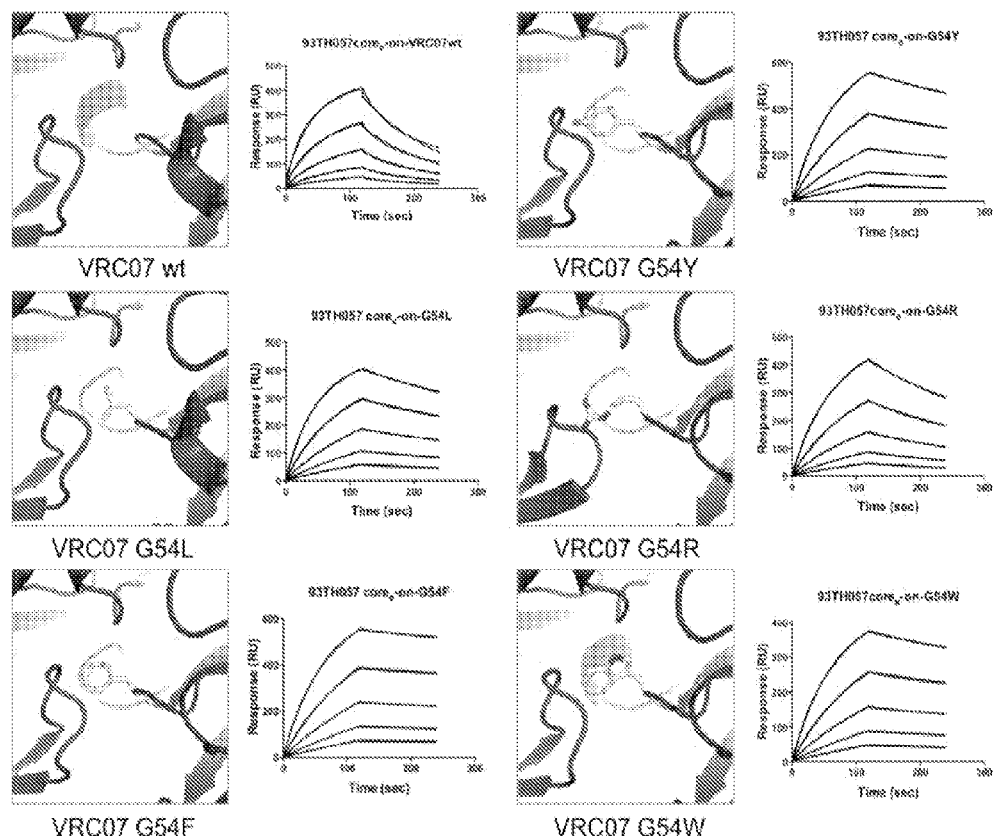
FIG. 10 is a series of digital images illustrating the protein structure of VRC07 (with the indicated amino acid substitutions) binding to gp120, and also a series of graphs showing results of surface plasma resonance experiments concerning the binding of the VRC07 (with the indicated amino acid substitutions) to gp120.
Figure 11:
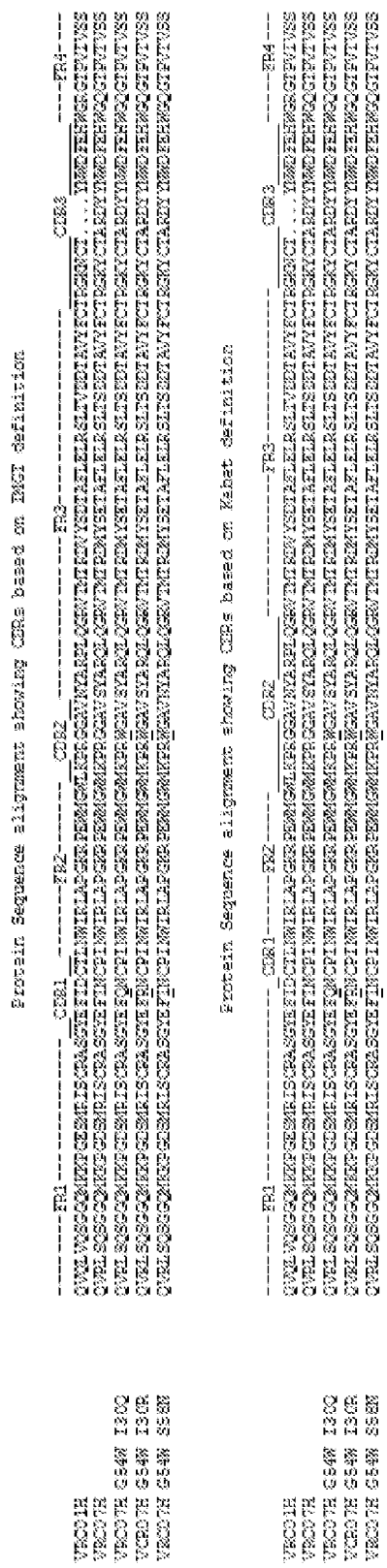
FIG. 11 shows the protein sequence alignment of the heavy chain variable domains of the VRC01 (SEQ ID NO: 5), VRC07 (SEQ ID NO: 2), VRC07 G54W, I30Q (SEQ ID NO: 24), VRC07 G54W, I30R (SEQ ID NO: 25), VRC07

Structure-based analysis was used to identify modifications that increase the potency and breadth of VRC07 antibody (See FIG. 9). Crystal structure analysis of the VRC07 heavy chain complemented with the VRC01 light chain (VRC07H/VRC01L) was used to identify amino acid substitutions that potentially optimized gp120 affinity and neutralization (see FIG. 10). Based on this analysis, several amino acid substitutions were generated and tested for the VRC07 heavy chain, including G54L, G54F, G54R, G54W, and G54Y substitutions (referring to Kabat positioning; see FIG. 11). Double substitutions were also tested by additionally incorporating the I30Q, I30R or S58N substitutions (see FIG. 11). The modified VRC07 heavy chains were complemented with VRC01 light chain and new antibodies were expressed, purified, and tested for affinities to HIV-1 gp120 proteins by surface plasma resonance (FIG. 10) and ELISA (FIG. 12A-12B) assays. Additional ELISA assays were also performed to examine gp120 binding of several different VRC07 heavy chain modifications complemented with VRC01 or VRC07 light chains (see FIG. 13; sequence information for the proteins indicated in FIG. 13 can be found herein, See Tables 2 and 3). Among the tested modifications, VRC07H (G54W) with I30R, I30Q, or/and S58N mutations showed affinities at least comparable or better than that of VRC07H (G54W) alone. The ability of antibodies containing these particular VRC07H/VRC01L modifications to neutralize the panel of HIV-1 viruses was also tested (See FIG. 14). The ELISA and neutralization assays were performed as described in Example 1. These findings indicated that certain VRC07 heavy chain amino acid substitutions increase the potency and breadth of this monoclonal antibody against the panel of tested HIV-1 viruses.

Example 4

Gp120 Binding and HIV-1 Neutralization

A series of monoclonal antibodies was tested for binding to various gp120 isoforms as well as for neutralization of a panel of HIV-1 viruses. The particular monoclonal antibodies are indicated in FIGS. 15, 16 and 17. Binding to gp120 proteins by the series of monoclonal antibodies was first examined by ELISA (see FIG. 15A-15LL). Additionally, the ability of these monoclonal antibodies to neutralize HIV viruses was tested (see FIG. 16). The ELISA and neutralization assays were performed as described in Example 1.

Design and Construction of Partial Germline Reversions.

Heavy and light chains based on VRC01, NIH4546, and VRC07 were designed using CDR grafting and partial germline reversion mutations. Structure/function analyses and an iterative testing approach were used to determine which resides to revert to germline while maintaining gp120 binding. Different heavy and light chains were combined to create recombinant IgG molecules. Briefly, heavy and light chains were transfected into 293F cells. After 6 days, antibodies were harvested from the cell supernatant, purified using Protein G, and tested for gp120 binding in ELISAs. Select antibodies were chosen for neutralization analysis against a panel of 7-12 HIV-1s (see FIG. 16).

Neutralization of HIV-1 by Optimized, Partially Reverted VRC01, NIH4546, and VRC07 Antibodies.

Select antibodies were tested for neutralization against a panel of 7-12 HIVs (see FIG. 16). Antibodies, the percent divergence from germline for the heavy and light chains, the IC50 values (μg/ml), the breadth, and the potency are all listed. The neutralization potency is compared to VRC01. Three optimization strategies were selected: (A) Mutations at position 54 in the heavy chain have been shown to increase binding and neutralization breadth and potency. G54F/W/Y mutations were tested in select antibodies. These mutations universally improved potency and/or breadth compared to wild type antibodies. For example, mature VRC07 G54W is over twice as potent as VRC07 and over 8 times as potent as mature VRC01. When the G54F/W/Y mutation was added to partial germline reversion antibodies, in 13 of 15 antibodies tested potency was above that of mature VRC01. (B) VRC01 light chain contains an N-linked glycosylation site. Glycosylation can cause heterogeneous products, which should be avoided in clinical-grade preparations. Five light chain mutants (N72E/F/S/T and T74I) were tested with the VRC07 G54W heavy chain. VRC01L N72F had the highest potency of the mutants. (C) The introduction of the G54 mutation to VRC07 decreased solubility of the protein. A panel of mutants to increase solubility (VRC07_hp_H01, VRC07_hp_L01 and VRC07_hp_L02) was designed. VRC07 G54W and VRC07_hp_L02 increased potency over the parental VRC07 G54W antibody.

Example 5

Alanine Scan of VRC01 Heavy Chain

Structure based analysis was used to select VRC01 heavy or light chain amino acid residues for alanine substitution to interrogate the relevance of the corresponding amino acid for VRC01 binding to gp120 (See FIG. 18). Based on this analysis, expression vectors encoding the selected VRC01 alanine mutants (indicated in FIG. 19A-19C with reference to Kabat numbering) were generated using standard molecular biology techniques. The modified VRC01 heavy and light chains were complemented with the corresponding heavy or light chain (unmodified) and new antibodies were expressed, purified, and tested for binding affinity to the indicated HIV-1 gp120 proteins. The technology is based by BioLayer Interferometry Technology (BLI) using a using FORTEBIO OCTET RED384™ system. The results illustrate that modification of specific VRC01 heavy and light chain residues can alter the binding affinity of VRC01 for gp120. In particular, the G54A substitution in the VRC01 heavy chain increased VRC01 binding affinity for gp120 by approximately one order of magnitude.

Example 6

HIV-1 Monoclonal Neutralizing Antibodies Specific to Gp120 for Detecting HIV-1 in a Subject This example describes the use of HIV-1 monoclonal neutralizing antibodies specific to gp120 for the detection of HIV-1 in a subject. This example further describes the use of these antibodies to confirm the diagnosis of HIV-1 in a subject.

A biological sample, such as a blood sample is obtained from the patient diagnosed with, or suspected of having an HIV-1 infection. A blood sample taken from a patient who is not infected is used as a control. An ELISA is performed to detect the presence of HIV-1 in the blood sample. Proteins present in the blood samples (the patient sample and control sample) are immobilized on a solid support, such as a 96-well plate, according to methods well known in the art (see, for example, Robinson et al., *Lancet* 362:1612-1616, 2003, incorporated herein by reference). Following immobilization, HIV-1 monoclonal neutralizing antibodies specific to gp120 that is directly labeled with a fluorescent marker is applied to the protein-immobilized plate. The plate is washed in an appropriate buffer, such as PBS, to remove any unbound antibody and to minimize non-specific binding of antibody. Fluorescence can be detected using a fluorometric plate reader according to standard methods. An increase in fluorescence intensity of the patient sample, relative to the control sample, indicates the anti-gp120 antibody specifically bound proteins from the blood sample, thus detecting the presence of HIV-1 protein in the sample. Detection of HIV-1 protein in the patient sample indicates the patient has HIV-1, or confirms diagnosis of HIV-1 in the subject.

Example 7

HIV-1 Monoclonal Neutralizing Antibodies Specific to Gp120 for the Treatment of HIV-1

This example describes a particular method that can be used to treat HIV in a human subject by administration of one or more gp120 specific human neutralizing mAbs. Although particular methods, dosages, and modes of administrations are provided, one skilled in the art will appreciate that variations can be made without substantially affecting the treatment.

Based upon the teaching disclosed herein HIV-1 can be treated by administering a therapeutically effective amount of one or more of the neutralizing mAbs described herein, thereby reducing or eliminating HIV infection.

Screening Subjects.

In particular examples, the subject is first screened to determine if they have HIV. Examples of methods that can be used to screen for HIV include a combination of measuring a subject's CD4+ T cell count and the level of HIV in serum blood levels. Additional methods using the gp120-specific mAbs disclosed herein can also be used to screen for HIV.

In some examples, HIV testing consists of initial screening with an enzyme-linked immunosorbent assay (ELISA) to detect antibodies to HIV, such as to HIV-1. Specimens with a nonreactive result from the initial ELISA are considered HIV-negative unless new exposure to an infected partner or partner of unknown HIV status has occurred. Specimens with a reactive ELISA result are retested in duplicate. If the result of either duplicate test is reactive, the specimen is reported as repeatedly reactive and undergoes confirmatory testing with a more specific supplemental test (e.g., Western blot or an immunofluorescence assay (IFA)). Specimens that are repeatedly reactive by ELISA and positive by IFA or reactive by Western blot are considered HIV-positive and indicative of HIV infection. Specimens that are repeatedly ELISA-reactive occasionally provide an indeterminate Western blot result, which may be either an incomplete antibody response to HIV in an infected person, or nonspecific reactions in an uninfected person. IFA can be used to confirm infection in these ambiguous cases. In some instances, a second specimen will be collected more than a month later and retested for subjects with indeterminate Western blot results. In additional examples, nucleic acid testing (e.g., viral RNA or proviral DNA amplification method) can also help diagnosis in certain situations.

The detection of HIV in a subject's blood is indicative that the subject has HIV and is a candidate for receiving the therapeutic compositions disclosed herein. Moreover, detection of a CD4+ T cell count below 350 per microliter, such as 200 cells per microliter, is also indicative that the subject is likely to have HIV.

Pre-screening is not required prior to administration of the therapeutic compositions disclosed herein.

Pre-Treatment of Subjects.

In particular examples, the subject is treated prior to administration of a therapeutic agent that includes one or more antiretroviral therapies known to those of skill in the art. However, such pre-treatment is not always required, and can be determined by a skilled clinician.

Administration of Therapeutic Compositions.

Following subject selection, a therapeutically effective dose of a gp120 specific neutralizing mAb described herein is administered to the subject (such as an adult human or a newborn infant either at risk for contracting HIV or known to be infected with HIV). Additional agents, such as antiviral agents, can also be administered to the subject simultaneously or prior to or following administration of the disclosed agents. Administration can be achieved by any method known in the art, such as oral administration, inhalation, intravenous, intramuscular, intraperitoneal, or subcutaneous.

The amount of the composition administered to prevent, reduce, inhibit, and/or treat HIV or a condition associated with it depends on the subject being treated, the severity of the disorder, and the manner of administration of the therapeutic composition. Ideally, a therapeutically effective amount of an agent is the amount sufficient to prevent, reduce, and/or inhibit, and/or treat the condition (e.g., HIV) in a subject without causing a substantial cytotoxic effect in the subject. A therapeutically effective amount can be readily determined by one skilled in the art, for example using routine trials establishing dose response curves. As such, these compositions may be formulated with an inert diluent or with an pharmaceutically acceptable carrier.

In one specific example, antibodies are administered at 5 mg per kg every two weeks or 10 mg per kg every two weeks depending upon the particular stage of HIV. In an example, the antibodies are administered continuously. In another example, antibodies or antibody fragments are administered at 50 μg per kg given twice a week for 2 to 3 weeks. Administration of the therapeutic compositions can be taken long term (for example over a period of months or years).

Assessment.

Following the administration of one or more therapies, subjects having HIV can be monitored for reductions in HIV levels, increases in a subjects CD4+ T cell count, or reductions in one or more clinical symptoms associated with HIV. In particular examples, subjects are analyzed one or more times, starting 7 days following treatment. Subjects can be monitored using any method known in the art. For example, biological samples from the subject, including blood, can be obtained and alterations in HIV or CD4+ T cell levels evaluated.

Additional Treatments.

In particular examples, if subjects are stable or have a minor, mixed or partial response to treatment, they can be re-treated after re-evaluation with the same schedule and preparation of agents that they previously received for the desired amount of time, including the duration of a subject's lifetime. A partial response is a reduction, such as at least a 10%, at least 20%, at least 30%, at least 40%, at least 50%, or at least 70% in HIV infection, HIV replication or combination thereof. A partial response may also be an increase in CD4+ T cell count such as at least 350 T cells per microliter.

Example 8

VRC07 G54 Mutants

Materials and Methods
  Generating the Mutants:
  Position G54 was mutated to each possible amino acid (A, C, D, E, F, H, U, K, L, M, N, P, Q, R, S, T, V, W, and Y). Each heavy chain was transiently transfected with the VRC01 light chain into 293F cells. Supernatants were harvested 5-6 days later and IgG was purified with Protein A or Protein G resin.
  ELISA (see FIGS. 20-22):
  Each resulting antibody was tested for binding by ELISA to a panel of gp120s. Recombinant gp120 was coated onto ELISA plates at 2 ug/ml overnight. Plates were washed 3-5 times with PBS-T, blocked with a 1% FBS and 5% milk solution, and washed again. VRC07 G54 mutants were tested at 0.4 ug/ml with a one hour incubation period. Plates were washed, and a secondary HRP-conjugated goat anti-human IgG antibody was added at a 1:5000 dilution. Following a one hour incubation, plates were washed and developed with TMB. The reaction was stopped with 1M H2SO4, and optical density was read at 450 nm.

Anti-Cardiolipin Assay (ACA) (FIG. 23):
Auto-reactivity of each VRC07 G54X mutant was analyzed with the QUANTA-LITE® ACA IgG III kit (INOVA Diagnostics™), an ELISA-based kit used clinically to diagnose autoimmune disorders. Each antibody was tested in serial three-fold dilutions starting at 100 ug/ml. Assay conditions were per manufacturer's protocol.

Neutralization (FIG. 24):
The antibodies with the highest binding the ELISA assays were tested in the TZM-bl neutralization assay, as described elsewhere in the patent.

Results
ELISA binding results for each VRC07 G54X mutant is shown for a panel of gp120s: Clade A1 and A2 consensus gp120s (FIG. 20); consensus sequences for Glade B and C (FIG. 21); and gp120 Du172, a VRC01-resistant strain (FIG. 22). For comparison, VRC01, wild type VRC07 (G54), and a human IgG1 negative control are shown. All antibodies were also tested for auto reactivity using the ACA (FIG. 23).

Autoreactive antibodies (e.g., antibodies that bind to human antigens such as cardiolipin, a component of mitochondrial membranes) may not be safe for in vivo use. Four G54 mutants (A, H, L, and Q) had both high ELISA binding and were negative on the ACA assay. These antibodies were tested in a six-virus neutralization panel. The G54H mutation improved neutralization over the wildtype by 2.3-2.5 fold (IC50 and IC80 values, respectively) (FIG. 24). The sequence of this mutant is shown in FIG. 25.

Example 9

Partial Germline Reversions can Increase VRC07 Potency and Breadth

VRC01 and related antibodies target the CD4 binding site (CD4bs) of gp120, are broadly neutralizing and highly potent, and have undergone high levels of somatic hypermutation. To optimize such antibodies for passive immunization and to further understand antibody development, antibodies were reverted towards their putative germlines and the effects on breadth and potency were analyzed.

VRC01, VRC07, and related antibodies are highly somatically mutated and their germline antibodies fail to bind gp120 or neutralize HIV-1. Key germline reversion mutations were also generated that increased neutralization potential. Reducing somatic mutations can also reduce the in vivo immunogenicity of the antibodies.

Structure/function-based analyses were used to design partially reverted heavy and light chains based on the mature and germline sequences of VRC07. Mature CDRs were maintained and framework regions were back-mutated to germline sequence. The design strategy is shown in FIGS. 26 and 27. FIG. 28 shows the mature VRC07 sequence (sHV), and germline sequence (gHV) and a number of partial germline mutations (VRC07ghvH0X.X). Three non-limiting germline reversion positions of interest are outlined in boxes (FIG. 28). Similar nomenclature is used for the light chain, which is also shown in FIG. 28. Neutralization against a panel of tier 2 HIV-1 pseudotyped viruses was determined for select antibodies (FIG. 29).

The somatic mutations were reduced by one half (44% to 19%) in the heavy chain and one third (29% to 19%) in the light chain, and mature residues were iteratively added back.

All back mutations were in the framework regions (FIG. 28). Most germline reversions were able to maintain basic functions, such as gp120 binding. Three germline mutations were identified in the heavy chain (Arg3Gln, Ile37Val, Thr93Ala) that increased potency by 1.3-fold (FIG. 29). The locations of these three mutations are shown in the VRC07 crystal structure in FIG. 30.

Example 10

N-Terminal Modifications of Light Chains

An alanine screen of the light chain gp120-contact residues showed that mutating Val3 to Ala on the light chain resulted in a 4-fold increase in binding (FIG. 19A). Additionally, the solved crystal structures of VRC01 and VRC07 lacked resolution of the two most N-terminal residues (VRC01) or 1 residue (VRC07), suggesting these residues did not make critical contact within the antibody or with gp120 (FIG. 31). The N-terminal domain of VRC01 light chain, including deletions and Ala and Gly substitutions of amino acids #1-4 is shown in FIG. 32. The light chains presented below can paired with any of the heavy chains disclosed herein.

Generating the Mutants:

Mutations were introduced into the plasmids using site-directed mutagenesis. Each resulting light chain was transfected with a VRC07 variant heavy chain into 293F cells. Supernatants were harvested 5-6 days later and IgG was purified with Protein A or Protein G resin.

Neutralization:

All antibodies were tested in the TZM-bl assay as described previously (see, e.g., PCT Pub. WO2011/038290).

Results.

A two amino acid deletion on a number of different of light chains resulted in an increased potency of ~2.5-fold (FIG. 33). Other N-terminal modifications increased neutralization potency up to 2.8 fold (FIG. 34).

Light Chain Consensus for N-Term Modifications:
$X_1X_2X_3X_4$TQSPGTLSLSPGETAIISCRTSQYGS LAWYQQRPGQAPRLVIYSGSTRAAGIPDRFS GSRWGPDYX$_5$LTISNLESGDFGVYYCQQYEFF GQGT-KVQVDIK (SEQ ID NO: 42), wherein $X_1$=E, G, A, deletion; $X_2$=I, G, A, deletion; $X_3$=V, G, A, deletion; $X_4$=L, G, A, deletion; $X_5$=N, F or T Exemplary Combinations:

(A) 4 different deletions (del-I-V-L; del-del-V-L; del-del-del-L; del-del-del-del, corresponding to
  i) SEQ ID NO: 42, wherein $X_1$ is no amino acid; $X_2$ is I; $X_3$ is V; $X_4$ is L; and $X_5$ is N, F or T;
  ii) SEQ ID NO: 42, wherein $X_1$ is no amino acid; $X_2$ is no amino acid; $X_3$ is V; $X_4$ is L; and $X_5$ is N, F or T;
  iii) SEQ ID NO: 42, wherein $X_1$ is no amino acid; $X_2$ is no amino acid; $X_3$ is no amino acid; $X_4$ is L; and $X_5$ is N, F or T;
  iv) SEQ ID NO: 42, wherein $X_1$ is no amino acid; $X_2$ is no amino acid; $X_3$ is V; $X_4$ is no amino acid; and $X_5$ is N, F or T;

(B) 4 alanine substitutions (same four combinations as above, but substitute Ala for deletion)
  i) SEQ ID NO: 42, wherein $X_1$ is A; $X_2$ is I; $X_3$ is V; $X_4$ is L; and $X_5$ is N, F or T;
  ii) SEQ ID NO: 42, wherein $X_1$ is A; $X_2$ is A; $X_3$ is V; $X_4$ is L; and $X_5$ is N, F or T;
  iii) SEQ ID NO: 42, wherein $X_1$ is A; $X_2$ is A; $X_3$ is A; $X_4$ is L; and $X_5$ is N, F or T;
  iv) SEQ ID NO: 42, wherein $X_1$ is A; $X_2$ is A; $X_3$ is V; $X_4$ is A; and $X_5$ is N, F or T;

(C) 4 glycine substitution (same four combinations as above, but substitute Gly for Del)
  i) SEQ ID NO: 42, wherein $X_1$ is G; $X_2$ is I; $X_3$ is V; $X_4$ is L; and $X_5$ is N, F or T;
  ii) SEQ ID NO: 42, wherein $X_1$ is G; $X_2$ is G; $X_3$ is V; $X_4$ is L; and $X_5$ is N, F or T;
  iii) SEQ ID NO: 42, wherein $X_1$ is G; $X_2$ is G; $X_3$ is G; $X_4$ is L; and $X_5$ is N, F or T;
  iv) SEQ ID NO: 42, wherein $X_1$ is G; $X_2$ is G; $X_3$ is G; $X_4$ is G; and $X_5$ is N, F or T;

(D) Del-del-V3A, i) SEQ ID NO: 42, wherein $X_1$ is no amino acid; $X_2$ is no amino acid; $X_3$ is A; $X_4$ is L; and $X_5$ is N, F or T;

(E) Del-Del-V3G, SEQ ID NO: 42, wherein $X_1$ is no amino acid; $X_2$ is no amino acid; $X_3$ is V; $X_4$ is L; and $X_5$ is N, F or T.

Additionally, the two amino acid deletion (E1/I2 deletion) plus (D) and (E) above were combined with additional amino acid substitutions to generate the following consensus light chain sequence: $X_1X_2$ $X_3$LTQSPGTLSLSPGETAX$_4$ISCRTSQYGSLA WYQQR-PGQAPRLVIYSGSTRAAGIPDRFSGSRX$_5$ GPDYX$_8$LTISNLESGDFGVYYCQQYEFFGQGT KVQX$_6$DX$_7$K (SEQ ID NO: 43, wherein $X_1$ is no amino acid or E, $X_2$ is no amino acid or I, $X_3$ is V, A or G, $X_4$ is T or I, $X_5$ is S or W; $X_6$ is V or Q, $X_7$ is N or I and $X_8$ is N or F). Specific sequences were complemented with VRC07 heavy chain and tested for binding to gp120, neutralization potency and self-reactivity, including:

EIVLTQSPGTLSLSPGETATISCRTSQYGSLAWY QQR-PGQAPRLVIYSGSTRAAGIPDRFSGSRSGPD YTLTISN-LESGDFGVYYCQQYEFFGQGTKVQQDNK (SEQ ID NO: 50; VRC01_hp-L02; SEQ ID NO: 43, wherein $X_1$ is E, $X_2$ is I, $X_3$ is V, $X_4$ is T, $X_5$ is S, $X_6$ is Q, $X_7$ is N and $X_8$ is T); as well as SEQ ID NO: 43, wherein $X_1$ is no amino acid, $X_2$ is no amino acid, $X_3$ is A, $X_4$ is T, $X_5$ is S, $X_6$ is Q, $X_7$ is N and $X_8$ is N or F; and SEQ ID NO: 43, wherein $X_1$ is no amino acid, $X_2$ is no amino acid, $X_3$ is G, $X_4$ is T, $X_5$ is S, $X_6$ is Q, $X_7$ is N, and $X_8$ is N or F.

In some embodiments the light chain variable domain of the antibody includes:

$X_1X_2X_3$LTQSPGTLSLSPGEX$_4$AX$_5$ISCRTSQYGSLA WYQQX$_6$PGQAPRLVIYSGSTRAAGIPDRFSGSR X$_7$GPDYX$_8$LTISX$_9$LESGDFGVYYCQQYE FFGX$_{10}$GTKVQVDIK (SEQ ID NO: 44, wherein $X_1$ is no amino acid or E, $X_2$ is no amino acid or I, $X_3$ is V, A or G, $X_4$ is R or T; $X_5$ is T or I, $X_6$ is K or R, $X_7$ is S or W, $X_8$ is T or N, $X_9$ is S or N, and $X_{10}$ is P or Q). Specific sequences were complemented with VRC07 heavy chain and tested for binding to gp120, neutralization potency and self-reactivity, including: EIVLTQSPGTLSLSPGERATISCRTSQYGSLA WYQQKPGQAPRLVIYSGSTRAAGIPDRFSGSRSGPD YTLTISSLESGDFGVYYCQQYEFFGPGTKVQVDIK (SEQ ID NO: 51; VRC07ghvL05, which is SEQ ID NO: 44, wherein $X_1$ is E, $X_2$ is I, $X_3$ is V, $X_4$ is R; $X_5$ is T, $X_6$ is K, $X_7$ is S, $X_8$ is T, $X_9$ is S, and $X_{10}$ is P); SEQ ID NO: 44, wherein $X_1$ is no amino acid, $X_2$ is no amino acid, $X_3$ is A, $X_4$ is R; $X_5$ is T, $X_6$ is K, $X_7$ is S, $X_8$ is T, $X_9$ is S, and $X_{10}$ is P; and SEQ ID NO: 44, wherein $X_1$ is no amino acid, $X_2$ is no amino acid, $X_3$ is G, $X_4$ is R; $X_5$ is T, $X_6$ is K, $X_7$ is S, $X_8$ is T, $X_9$ is S, and $X_{10}$ is P In additional embodiments the light chain variable domain includes one of:

1. VRC01L:
(SEQ ID NO: 9)
EIVLTQSPGTLSLSPGETAIISCRTSQYGSLAWYQQRPGQAPRLVIYSGS

TRAAGIPDRFSGSRWGPDYNLTISNLESGDFGVYYCQQYEFFGQGTKVQV

DIK

2. VRC01-E1/I2-deletion:
(SEQ ID NO: 53)
VLTQSPGTLSLSPGETAIISCRTSQYGSLAWYQQRPGQAPRLVIYSGSTR

AAGIPDRFSGSRWGPDYNLTISNLESGDFGVYYCQQYEFFGQGTKVQVDI

K

3. VRC01-N72T-E1/I2-deletion:
(SEQ ID NO: 54)
VLTQSPGTLSLSPGETAIISCRTSQYGSLAWYQQRPGQAPRLVIYSGSTR

AAGIPDRFSGSRWGPDYTLTISNLESGDFGVYYCQQYEFFGQGTKVQVDI

K

4. VRC01hpL02:
(SEQ ID NO: 50)
EIVLTQSPGTLSLSPGETATISCRTSQYGSLAWYQQRPGQAPRLVIYSGS

TRAAGIPDRFSGSRSGPDYTLTISNLESGDFGVYYCQQYEFFGQGTKVQQ

DNK

5. VRC01hpL02-E1/I2-deletion:
(SEQ ID NO: 56)
VLTQSPGTLSLSPGETATISCRTSQYGSLAWYQQRPGQAPRLVIYSGSTR

AAGIPDRFSGSRSGPDYTLTISNLESGDFGVYYCQQYEFFGQGTKVQQDN

K

Example 11

Plasmids and Plasmid Inserts

The following are the names and corresponding SEQ ID NOs of the nucleotide sequence of plasmid inserts for expression of variant VRC07 heavy chains:

TABLE 2

Plasmid names and Sequences

| Heavy or Light Chain Name | Insert SEQ ID NO | Plasmid SEQ ID NO |
|---|---|---|
| VRC07 S58N | 57 | 58 |
| VRC07ghvH05.1 | 59 | 60 |
| VRC07ghvH05.2 | 61 | 62 |
| VRC07ghvH05.3 | 63 | 64 |
| VRC07ghvH05.3.1 | 65 | 66 |
| VRC07ghvH05.3.2 | 67 | 68 |
| VRC07ghvH05.3.3 | 69 | 70 |
| VRC07ghvH05.3.4 | 71 | 72 |
| VRC07ghvH05.3.5 | 73 | 74 |
| VRC07ghvH05.3.6 | 75 | 76 |
| VRC07ghvH05.4 | 77 | 78 |
| VRC07ghvH05.4.1 | 79 | 80 |
| VRC07ghvH05.4.2 | 81 | 82 |
| VRC07ghvH05.4.3 | 83 | 84 |
| VRC07ghvH05.4.4 | 85 | 86 |
| VRC07ghvH05.4.5 | 87 | 88 |
| VRC07ghvH05.4.6 | 89 | 90 |
| V1v7h3m02G54W | 91 | 92 |
| V1v7h3m03G54W | 93 | 94 |

TABLE 2-continued

Plasmid names and Sequences

| Heavy or Light Chain Name | Insert SEQ ID NO | Plasmid SEQ ID NO |
|---|---|---|
| VRC07H G54W I30Q | 95 | 96 |
| VRC07H G54W I30R | 97 | 98 |
| VRC07H G54W S58N | 99 | 100 |
| VRC07ghvH05 | 109 | 110 |
| VRC01ghvL05 | 111 | 112 |
| VRC07chH01 | 113 | 114 |
| VRC01chL01 | 115 | 116 |
| VRC07hpH01 | 117 | 118 |
| VRC01hpL01 | 119 | 120 |
| VRC01hpL02 | 121 | 122 |
| VRC01ghvH03 | 123 | 124 |
| NIH4546H | 125 | 126 |
| NIH4546ghvH01 | 127 | 128 |
| NIH4546ghvH02 | 129 | 130 |
| VRC07ghvH01 | 131 | 132 |
| VRC07ghvH02 | 133 | 134 |
| VRC01ghvL02 | 135 | 136 |
| VRC01ghvL04 | 137 | 138 |
| VRC01-L-N72T | 139 | 140 |
| NIH4546L | 141 | 142 |
| NIH4546ghvL01 | 143 | 144 |
| VRC07ghvH04.1 | 145 | 146 |
| VRC07ghvH04.2 | 147 | 148 |
| VRC07CDRH2.M1 | 149 | 150 |
| VRC07CDRH2.M2 | 151 | 152 |
| NIH4546H G54F | 153 | 154 |
| NIH4546H G54W | 155 | 156 |
| VRC01ghvL02 | 157 | 158 |
| VRC01ghvL04 | 159 | 160 |
| VRC01H G54F | 161 | 162 |
| VRC01H G54W | 163 | 164 |
| VRC01ghvL02 | 165 | 166 |
| VRC01ghvL04 | 167 | 168 |
| VRC01L N72E | 169 | 170 |
| VRC01L N72F | 171 | 172 |
| VRC01L N72S | 173 | 174 |
| VRC01L T74I | 175 | 176 |
| VRC07 CDRH2.M1 G54F | 177 | 178 |
| VRC07 CDRH2.M1 G54W | 179 | 180 |
| VRC07 CDRH2.M1 G54Y | 181 | 182 |
| VRC07ghvH04.1 G54F | 183 | 184 |
| VRC07ghvH04.1 G54W | 185 | 186 |
| VRC07ghvH04.1 G54Y | 187 | 188 |
| VRC07ghvH04.2 G54F | 189 | 190 |
| VRC07ghvH04.1 G54Y | 191 | 192 |
| VRC07ghvH04.2 G54F | 193 | 194 |

Additional nucleotide and protein sequences for plasmid inserts for expression of variant VRC07 heavy chains:

TABLE 3

Plasmid names and Sequences

| Heavy Chain Name | Insert nucleotide SEQ ID NO | Insert protein SEQ ID NO |
|---|---|---|
| VRC07 H G54F | 101 | 102 |
| VRC07 H G54R | 103 | 104 |
| VRC07 H G54W | 105 | 106 |
| VRC07 H G54Y | 107 | 108 |

In view of the many possible embodiments to which the principles of the disclosure may be applied, it should be recognized that illustrated embodiments are only examples and should not be considered a limitation on the scope of the claims. We therefore claim all that comes within the scope and spirit of these claims.

SEQUENCE LISTING (260 sequences)

SEQ ID NO: 1 - protein, 125 aa, Artificial Sequence
  Description of Artificial Sequence: Synthetic consensus sequence
  MISC_FEATURE (11)..(11): Met or Val
  MISC_FEATURE (28)..(28): Glu or Asp
  MISC_FEATURE (30)..(30): Ile, Arg or Gln
  MISC_FEATURE (43)..(43): Lys or Arg
  MISC_FEATURE (51)..(51): Met or Val
  MISC_FEATURE (55)..(55): Ala, His, Lys, Met, Gln, Val, Gly, Phe, Arg, Tyr or Trp
  MISC_FEATURE (59)..(59): Asn or Ser
  MISC_FEATURE (64)..(64): Leu or Phe
  MISC_FEATURE (74)..(74): Met or Val
  MISC_FEATURE (77)..(77): Glu or Asp
  MISC_FEATURE (85)..(85): Ser, Ala or Pro
  MISC_FEATURE (117)..(117): Gln or Arg
  MISC_FEATURE (120)..(120): Pro or Leu
QVRLSQSGGQXKKPGDSMRISCRASGYXFXNCPINWIRLAPGXRPEWMGWXKPRXGAVXYARQXQGRVTMTRDXYSXTAFLELRXLTSDDTAVYFCTRGKYCTARDYYNWDFEHWGXGTXVTVSS

SEQ ID NO: 2 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRGGAVSYARQLQGRVTMTRDMYSETAFLELRSLTSDDTAVYFCTRGKYCTARDYYNWDFEHWGQGTPVTVSS

SEQ ID NO: 3 - protein, 125 aa, Artificial Sequence
  Description of Artificial Sequence: Synthetic polypeptide
QVRLSQSGGQVKKPGDSMRISCRASGYDFINCPINWIRLAPGRRPEWMGWVKPRGGAVNYARQFQGRVTMTRDVYSDTAFLELRALTSDDTAVYFCTRGKYCTARDYYNWDFEHWGRGTLVTVSS

SEQ ID NO: 4 - protein, 125 aa, Artificial Sequence
  Description of Artificial Sequence: Synthetic polypeptide
QVRLSQSGGQVKKPGDSMRISCRASGYDFINCPINWIRLAPGRRPEWMGWVKPRGGAVNYARQFQGRVTMTRDVYSDTAFLELRPLTSDDTAVYFCTRGKYCTARDYYNWDFEHWGRGTLVTVSS

SEQ ID NO: 5 - protein, 122 aa, Artificial Sequence
  Description of Artificial Sequence: Synthetic polypeptide
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSP

SEQ ID NO: 6 - protein, 103 aa, Artificial Sequence
  Description of Artificial Sequence: Synthetic consensus sequence
  MISC_FEATURE (9)..(9): Ala or Gly
  MISC_FEATURE (18)..(18): Arg or Thr
  MISC_FEATURE (21)..(21): Ile or Leu
  MISC_FEATURE (26)..(26): Ser or Thr
  MISC_FEATURE (48)..(48): Ser or Ala
  MISC_FEATURE (54)..(54): Ala or Thr
  MISC_FEATURE (67)..(67): Ala or Pro
  MISC_FEATURE (68)..(68): Glu or Asp
  MISC_FEATURE (79)..(79): Glu or Gly
EIVLTQSPXTLSLSPGEXAIXSCRTXQYGSLAWYQQRPGQAPRLVIYXGSTRAXGIPDRFSGSRWGXXYNLTISNLESXDFGVYYCQQYEFFGQGTKVQVDIK

SEQ ID NO: 7 - protein, 103 aa, Artificial Sequence
  Description of Artificial Sequence: Synthetic polypeptide
EIVLTQSPATLSLSPGERAIISCRTSQYGSLAWYQQRPGQAPRLVIYAGSTRATGIPDRFSGSRWGAEYNLTISNLESEDFGVYYCQQYEFFGQGTKVQVDIK

SEQ ID NO: 8 - protein, 103 aa, Artificial Sequence
  Description of Artificial Sequence: Synthetic polypeptide
EIVLTQSPATLSLSPGERAIISCRTTQYGSLAWYQQRPGQAPRLVIYAGSTRATGIPDRFSGSRWGADYNLTISNLESEDFGVYYCQQYEFFGQGTKVQVDIK

SEQ ID NO: 9 - protein, 104 aa, Artificial Sequence
  Description of Artificial Sequence: Synthetic polypeptide
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKR

SEQ ID NO: 10 - DNA, 375 bp, Artificial Sequence
  Description of Artificial Sequence: Synthetic polynucleotide
caggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctagggggggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtca

SEQ ID NO: 11 - DNA, 375 bp, Artificial Sequence
  Description of Artificial Sequence: Synthetic polynucleotide
caagtgcgactgtcgcagtctggaggtcaggtgaagaagcctggcgactcgatgagaatttcttgtcgggcttctggatatgacttcattaactgtcctataaattggatccgcctggcccccggaagaaggcctgagtggatgggatgggtgaagcctagggggggggccgtgaattacgcacgccaatttcagggcagagtgaccatgactcgagacgtctacagcgacacagcctttttggagctgcgcgccttgacatcagacgacacggccgtctacttttgtactaggggaaaatactgtactgcgcgcgactattacaattgggacttcgaacactggggccggggcaccctggtcaccgtctcttca

SEQ ID NO: 12 - DNA, 375 bp, Artificial Sequence
  Description of Artificial Sequence: Synthetic polynucleotide
caagtgcgactgtcgcagtctggaggtcaggtgaagaagcctggcgactcgatgagaatttcttgtcgggcttctggatatgacttcattaattgtcctataaattggatccgcctggcccccggaagaaggcctgagtggatgggatgggtgaagcctagggggggggccgttaattacgcacgccaatttcagggcagagtgaccatgacgcgagacgtgtattccgacacagcctttttggaactgcgccccttgacatcagacgacacggccgtctatttttgcactaggggaaaatactgtactgcgcgcgactattacaattgggacttcgaacactggggccggggcaccctcgtcaccgtctcatca

SEQ ID NO: 13 - DNA, 365 bp, Artificial Sequence
  Description of Artificial Sequence: Synthetic polynucleotide
caggtgcagctggtgcagtctgggggtcagatgaagaagcctggcgagtcgatgagaatttcttgtcgggcttctggatatgaatttattgattgtacgctaaattggattcgtctggcccccggaaaaaggcctgagtggatgggatggctgaagcctcgggggggggccgtcaactacgcacgtccacttcagggcagagtgaccatgactcgagacgtttattccgacacagcctttttggagctgcgctcgttgacagtagacgacacggccgtctacttttgtactaggggaaaaaactgtgattacaattgggacttcgaacactggggccggggcaccccggtcatcgtctcatcacc

SEQ ID NO: 14 - DNA, 309 bp, Artificial Sequence
  Description of Artificial Sequence: Synthetic polynucleotide
gaaattgtgttgacacagtctccagccaccctgtctttgtctccaggggaaagagccatcctctcttgtcggaccagtcagtatggttccttagcctggtaccaacagaggcccggccaggcccccaggctcgtcatctatgctggctctactagggccactggcatcccagacaggttcagcggcagtaggtggggggcagagtacaatctcaccatcagcaacctggagtcggaagattttggtgtttattattgtcagcagtatgaattttttggccaggggaccaaggtccaggtcgacattaag

SEQ ID NO: 15 - DNA, 309 bp, Artificial Sequence
  Description of Artificial Sequence: Synthetic polynucleotide
gaaattgtgttgacacagtctccagccaccctgtctttgtctccaggggaaagagccatcctctcttgtcggaccactcagtatggttccttagcctggtaccaacagaggcccggccaggcccccaggctcgtcatctatgctggctctactagggccactggcatcccagacaggttcagcggcagtaggtggggggcagactacaatctcaccatcagcaacctggagtcggaagattttggtgtttattattgtcagcagtatgaattttttggccaggggaccaaggtccaggtcgacattaaa

SEQ ID NO: 16 - DNA, 312 bp, Artificial Sequence
  Description of Artificial Sequence: Synthetic polynucleotide
gaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacaatctcaccatcagcaacctggagtcgggagattttggtgtttattattgccagcagtatgaattttttggccaggggaccaaggtccaggtcgacattaagcga

SEQ ID NO: 17 - DNA, 24 bp, Artificial Sequence
  Description of Artificial Sequence: Synthetic primer
acaggtgcccactcccaggtgcag

SEQ ID NO: 18 - DNA, 21 bp, Artificial Sequence
  Description of Artificial Sequence: Synthetic primer
gcagccacaggtgcccactcc

SEQ ID NO: 19 - DNA, 22 bp, Artificial Sequence
  Description of Artificial Sequence: Synthetic primer
cagcagctacaggcacccacgc

SEQ ID NO: 20 - DNA, 25 bp, Artificial Sequence
  Description of Artificial Sequence: Synthetic primer
ggcagcagctacaggtgtccagtcc

SEQ ID NO: 21 - DNA, 27 bp, Artificial Sequence
  Description of Artificial Sequence: Synthetic primer
gggggaagaccgatgggcccttggtgg

SEQ ID NO: 22 - DNA, 21 bp, Artificial Sequence
  Description of Artificial Sequence: Synthetic primer
gggaattctcacaggagacga

SEQ ID NO: 23 - protein, 125 aa, Artificial Sequence
  Description of Artificial Sequence: Synthetic consensus sequence
  MISC_FEATURE (30)..(30): Ile, Arg or Gln
  MISC_FEATURE (55)..(55): Gly, Phe, Arg, Tyr or Trp
  MISC_FEATURE (59)..(59): Ser or Asn
QVRLSQSGGQMKKPGDSMRISCRASGYEFXNCPINWIRLAPGKRPEWMGWMKPRXGAVXYARQLQGRVTMTRDMYSETAFLELRSLTSDDTAVYFCTRGKYCTARDYYNWDFEHWGQGTPVTVSS

SEQ ID NO: 24 - protein, 125 aa, Artificial Sequence
  Description of Artificial Sequence: Synthetic polypeptide
QVRLSQSGGQMKKPGDSMRISCRASGYEFQNCPINWIRLAPGKRPEWMGWMKPRWGAVSYARQLQGRVTMTRDMYSETAFLELRSLTSDDTAVYFCTRGKYCTARDYYNWDFEHWGQGTPVTVSS

SEQ ID NO: 25 - protein, 125 aa, Artificial Sequence
  Description of Artificial Sequence: Synthetic polypeptide
QVRLSQSGGQMKKPGDSMRISCRASGYEFRNCPINWIRLAPGKRPEWMGWMKPRWGAVSYARQLQGRVTMTRDMYSETAFLELRSLTSDDTAVYFCTRGKYCTARDYYNWDFEHWGQGTPVTVSS

SEQ ID NO: 26 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRWGAVNYARQLQGRVTMTRDMYSETAFLELRSLTSDDTAVYFCTRGKYCTARDYYNWDFEHWGQGTPVTVSS

SEQ ID NO: 27 - protein, 104 aa, Artificial Sequence
  Description of Artificial Sequence: Synthetic polypeptide
EIVLTQSPGTLSLSPGETAIISCRTSQYGSLAWYQQRPGQAPRLVIYSGSTRAAGIPDRFSGSRWGPDYALTISNLESGDFGVYYCQQYEFFGQGTKVQVDIKR

SEQ ID NO: 28 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRWGAVSYARQLQGRVTMTRDMYSETAFLELRSLTSDDTAVYFCTRGKYCTARDYYNWDFEHWGQGTPVTVSS

SEQ ID NO: 29 - protein, 125 aa, Artificial Sequence
  Description of Artificial Sequence: Synthetic consensus sequence
  MISC_FEATURE (11)..(11): Met or Val
  MISC_FEATURE (28)..(28): Glu or Asp
  MISC_FEATURE (43)..(43): Lys or Arg
  MISC_FEATURE (51)..(51): Met or Val
  MISC_FEATURE (59)..(59): Asn or Ser
  MISC_FEATURE (64)..(64): Leu or Phe
  MISC_FEATURE (74)..(74): Met or Val
  MISC_FEATURE (77)..(77): Glu or Asp
  MISC_FEATURE (85)..(85): Ser, Ala or Pro
  MISC_FEATURE (117)..(117): Gln or Arg
  MISC_FEATURE (120)..(120): Pro or Leu
QVRLSQSGGQXKKPGDSMRISCRASGYXFINCPINWIRLAPGXRPEWMGWXKPRGGAVXYARQXQGRVTMTRDXYSXTAFLELRXLTSDDTAVYFCTRGKYCTARDYYNWDFEHWGXGTXVTVSS

SEQ ID NO: 30 - protein, 125 aa, Artificial Sequence
  Description of Artificial Sequence: Synthetic polypeptide
  MISC_FEATURE (55)..(55): Ala, Phe, His, Lys, Met, Gln, Arg, Val, Trp or Tyr
QVRLSQSGGQMKKPGDSMRISCRASGYEFINCPINWIRLAPGKRPEWMGWMKPRXGAVSYARQLQGRVTMTRDMYSETAFLELRSLTSDDTAVYFCTRGKYCTARDYYNWDFEHWGQGTPVTVSS

SEQ ID NO: 31 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRAGAVSYARQLQGRVTMTRDMYSETAFLELRSLTSDDTAVYFCTRGKYCTARDYYNWDFEHWGQGTPVTVSS

SEQ ID NO: 32 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSS

SEQ ID NO: 33 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRKGAVSYARQLQGRVTMTRDMYSETAFLELRSLTSDDTAVYFCTRGKYCTARDYYNWDFEHWGQGTPVTVSS

SEQ ID NO: 34 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRMGAVSYARQLQGRVTMTRDMYSETAFLELRSLTSDDTAVYFCTRGKYCTARDYYNWDFEHWGQGTPVTVSS

SEQ ID NO: 35 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRQGAVSYARQLQGRVTMTRDMYSETAFLELRSLTSDDTAVYFCTRGKYCTARDYYNWDFEHWGQGTPVTVSS

SEQ ID NO: 36 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRVGAVSYARQLQGRVTMTRDMYSETAFLELRSLTSDDTAVYFCTRGKYCTARDYYNWDFEHWGQGTPVTVSS

SEQ ID NO: 37 - DNA, 375 bp, Artificial Sequence
  modified antibody sequence
caggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctaggcatggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtca

SEQ ID NO: 38 - protein, 125 aa, Artificial Sequence
  Description of Artificial Sequence: Synthetic consensus sequence
  MISC_FEATURE (3)..(3): Gln or Arg
  MISC_FEATURE (37)..(37): Val or Ile
  MISC_FEATURE (97)..(97): Ala or Thr
QVXLSQSGGQMKKPGDSMRISCRASGYEFINCPINWXRLAPGKRPEWMGWMKPRGGAVSYARQLQGRVTMTRDMYSETAFLELRSLTSDDTAVYFCXRGKYCTARDYYNWDFEHWGQGTPVTVSS

SEQ ID NO: 39 - protein, 125 aa, Artificial Sequence
  Description of Artificial Sequence: Synthetic polypeptide
QVQLSQSGGQMKKPGDSMRISCRASGYEFINCPINWVRLAPGKRPEWMGWMKPRGGAVSYARQLQGRVTMTRDMYSETAFLELRSLTSDDTAVYFCARGKYCTARDYYNWDFEHWGQGTPVTVSS

SEQ ID NO: 40 - protein, 125 aa, Artificial Sequence
  Description of Artificial Sequence: Synthetic consensus sequence
  MISC_FEATURE (37)..(37): Ile or Val
  MISC_FEATURE (55)..(55): Gly or His
  MISC_FEATURE (59)..(59): Ser or Asn
  MISC_FEATURE (97)..(97): Thr or Ala
QVRLSQSGGQMKKPGDSMRISCRASGYEFINCPINWXRLAPGKRPEWMGWMKPRXGAVXYARQLQGRVTMTRDMYSETAFLELRSLTSDDTAVYFCXRGKYCTARDYYNWDFEHWGQGTPVTVSS

SEQ ID NO: 41 - protein, 103 aa, Artificial Sequence
  Description of Artificial Sequence: Synthetic consensus sequence
  MISC_FEATURE (1)..(2): May or may not be present
  MISC_FEATURE (20)..(20): Thr or Ile
  MISC_FEATURE (65)..(65): Trp or Ser
  MISC_FEATURE (70)..(70): Asn or Thr
  MISC_FEATURE (100)..(100): Val or Gln
  MISC_FEATURE (102)..(102): Ile or Asn
EIVLTQSPGTLSLSPGETAXISCRTSQYGSLAWYQQRPGQAPRLVIYSGSTRAAGIPDRFSGSRXGPDYXLTISNLESGDFGVYYCQQYEFFGQGTKVQXDXK

SEQ ID NO: 42 - protein, 103 aa, Artificial Sequence
  Description of Artificial Sequence: Synthetic consensus sequence
  MISC_FEATURE (1)..(1): Glu, Gly, Ala or absent
  MISC_FEATURE (2)..(2): Ile, Gly, Ala or absent
  MISC_FEATURE (3)..(3): Val, Gly, Ala or absent
  MISC_FEATURE (4)..(4): Leu, Gly, Ala or absent
  MISC_FEATURE (70)..(70): Asn, Phe or Thr
XXXXTQSPGTLSLSPGETAIISCRTSQYGSLAWYQQRPGQAPRLVIYSGSTRAAGIPDRFSGSRWGPDYXLTISNLESGDFGVYYCQQYEFFGQGTKVQVDIK

SEQ ID NO: 43 - protein, 103 aa, Artificial Sequence
  Description of Artificial Sequence: Synthetic polypeptide
  MISC_FEATURE (1)..(2): May or may not be present
  MISC_FEATURE (3)..(3): Val, Ala or Gly
  MISC_FEATURE (20)..(20): Thr or Ile
  MISC_FEATURE (65)..(65): Ser or Trp
  MISC_FEATURE (70)..(70): Asn or Phe
  MISC_FEATURE (100)..(100): Val or Gln
  MISC_FEATURE (102)..(102): Asn or Ile
EIXLTQSPGTLSLSPGETAXISCRTSQYGSLAWYQQRPGQAPRLVIYSGSTRAAGIPDRFSGSRXGPDYXLTISNLESGDFGVYYCQQYEFFGQGTKVQXDXK

SEQ ID NO: 44 - protein, 103 aa, Artificial Sequence
  Description of Artificial Sequence: Synthetic polypeptide
  MISC_FEATURE (1)..(2): May or may not be present
  MISC_FEATURE (3)..(3): Val, Ala or Gly
  MISC_FEATURE (18)..(18): Arg or Thr
  MISC_FEATURE (20)..(20): Thr or Ile
  MISC_FEATURE (37)..(37): Lys or Arg
  MISC_FEATURE (65)..(65): Ser or Trp
  MISC_FEATURE (70)..(70): Thr or Asn
  MISC_FEATURE (75)..(75): Ser or Asn
  MISC_FEATURE (94)..(94): Pro or Gln
EIXLTQSPGTLSLSPGEXAXISCRTSQYGSLAWYQQXPGQAPRLVIYSGSTRAAGIPDRFSGSRXGPDYXLTISXLESGDFGVYYCQQYEFFGXGTKVQVDIK

SEQ ID NO: 45 - protein, 6 aa, Artificial Sequence
  Description of Artificial Sequence: Synthetic peptide
TNNAKT

SEQ ID NO: 46 - protein, 4 aa, Artificial Sequence
  Description of Artificial Sequence: Synthetic peptide
SGGD

SEQ ID NO: 47 - protein, 5 aa, Artificial Sequence
  Description of Artificial Sequence: Synthetic peptide
TRDGG

SEQ ID NO: 48 - protein, 15 aa, Artificial Sequence
  Description of Artificial Sequence: Synthetic peptide
GGGGSGGGGSGGGGS

SEQ ID NO: 49 - DNA, 18 bp, Artificial Sequence
  Description of Artificial Sequence: Synthetic oligonucleotide
  misc_feature (1)..(18): This sequence may encompass 12 to 18 nucleotides
tttttttttttttttttt

SEQ ID NO: 50 - protein, 103 aa, Artificial Sequence
  Description of Artificial Sequence: Synthetic polypeptide
EIVLTQSPGTLSLSPGETATISCRTSQYGSLAWYQQRPGQAPRLVIYSGSTRAAGIPDRFSGSRSGPDYTLTISNLESGDFGVYYCQQYEFFGQGTKVQQDNK

SEQ ID NO: 51 - protein, 103 aa, Artificial Sequence
  Description of Artificial Sequence: Synthetic polypeptide
EIVLTQSPGTLSLSPGERATISCRTSQYGSLAWYQQKPGQAPRLVIYSGSTRAAGIPDRFSGSRSGPDYTLTISSLESGDFGVYYCQQYEFFGPGTKVQVDIK

SEQ ID NO: 52 - protein, 103 aa, Artificial Sequence
  Description of Artificial Sequence: Synthetic polypeptide
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 53 - protein, 101 aa, Artificial Sequence
  Description of Artificial Sequence: Synthetic polypeptide
VLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 54 - protein, 101 aa, Artificial Sequence
  Description of Artificial Sequence: Synthetic polypeptide
VLTQSPGTLSLSPGETAIISCRTSQYGSLAWYQQRPGQAPRLVIYSGSTRAAGIPDRFSGSRWGPDYTLTISNLESGDFGVYYCQQYEFFGQGTKVQVDIK

SEQ ID NO: 55 - protein, 103 aa, Artificial Sequence; identical to SEQ ID NO: 50
  Description of Artificial Sequence: Synthetic polypeptide

SEQ ID NO: 56 - protein, 101 aa, Artificial Sequence
  Description of Artificial Sequence: Synthetic polypeptide
VLTQSPGTLSLSPGETATISCRTSQYGSLAWYQQRPGQAPRLVIYSGSTRAAGIPDRFSGSRSGPDYTLTISNLESGDFGVYYCQQYEFFGQGTKVQQDNK

SEQ ID NO: 57 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctagggggggggccgtcaattacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 58 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctagggggggggccgtcaattacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 59 - DNA, 1425 bp, Artificial Sequence
  Description of Artificial Sequence: Synthetic polynucleotide
atgggatggtcatgtatcatcctttttctagtagcaactgcaaccggtgtacattcccaggtccagctgagccagagcggggggcagatgaaaaagccaggagatagcatgagggtgtcttgtaaagcaagcgggtatgagtttatcaactgcccaattaattgggtgcggctggcaccaggacagagacctgagtggatgggatggatgaagccacgagggggagccgtgagctacgctaggcagctgcagggacgcgtcaccatgacacgagacatgtacagctccaccgcttatctggagctgcggagactgacatctgacgatactgcagtctactattgcgccaggggcaaatattgtacagcacgcgactactataactgggatttcgaacactggggacagggaactcccgtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 60 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccagctgagccagagcggggggcagatgaaaaagccaggagatagcatgagggtgtcttgtaaagcaagcgggtatgagtttatcaactgcccaattaattgggtgcggctggcaccaggacagagacctgagtggatgggatggatgaagccacgagggggagccgtgagctacgctaggcagctgcagggacgcgtcaccatgacacgagacatgtacagctccaccgcttatctggagctgcggagactgacatctgacgatactgcagtctactattgcgccaggggcaaatattgtacagcacgcgactactataactgggatttcgaacactggggacagggaactcccgtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 61 - DNA, 1425 bp, Artificial Sequence
  Description of Artificial Sequence: Synthetic polynucleotide
atgggatggtcatgtatcatcctttttctagtagcaactgcaaccggtgtacattcccaggtgcagctgagccagagcggcggacagatgaaaaagccaggcgattctatgcggatttcttgtaaagccagcggatacgagttcatcaactgcccaattaattgggtgcgcctggcaccaggacagcgacctgagtggatgggatggatgaagccacgagggggagccgtgtcttacgctcgacagctgcagggaagagtcaccatgacaagggacatgtacagctccaccgcttatctggagctgaggtcactgacaagcgacgatactgcagtctactattgcgcccggggcaaatattgtacagcaagagactactataactgggatttcgaacactggggacagggaactcccgtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 62 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtgcagctgagccagagcggcggacagatgaaaaagccaggcgattctatgcggatttcttgtaaagccagcggatacgagttcatcaactgcccaattaattgggtgcgcctggcaccaggacagcgacctgagtggatgggatggatgaagccacgagggggagccgtgtcttacgctcgacagctgcagggaagagtcaccatgacaagggacatgtacagctccaccgcttatctggagctgaggtcactgacaagcgacgatactgcagtctactattgcgcccggggcaaatattgtacagcaagagactactataactgggatttcgaacactggggacagggaactcccgtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 63 - DNA, 1425 bp, Artificial Sequence
  Description of Artificial Sequence: Synthetic polynucleotide
atgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 64 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 65 - DNA, 1425 bp, Artificial Sequence
  Description of Artificial Sequence: Synthetic polynucleotide
atgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 66 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 67 - DNA, 1425 bp, Artificial Sequence
  Description of Artificial Sequence: Synthetic polynucleotide
atgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 68 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 69 - DNA, 1425 bp, Artificial Sequence
  Description of Artificial Sequence: Synthetic polynucleotide
atgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 70 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 71 - DNA, 1425 bp, Artificial Sequence
  Description of Artificial Sequence: Synthetic polynucleotide
atgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 72 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 73 - DNA, 1425 bp, Artificial Sequence
  Description of Artificial Sequence: Synthetic polynucleotide
atgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 74 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 75 - DNA, 1425 bp, Artificial Sequence
  Description of Artificial Sequence: Synthetic polynucleotide
atgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 76 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgagctacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 77 - DNA, 1425 bp, Artificial Sequence
  Description of Artificial Sequence: Synthetic polynucleotide
atgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 78 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 79 - DNA, 1425 bp, Artificial Sequence
  Description of Artificial Sequence: Synthetic polynucleotide
atgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 80 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 81 - DNA, 1425 bp, Artificial Sequence
  Description of Artificial Sequence: Synthetic polynucleotide
atgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 82 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 83 - DNA, 1425 bp, Artificial Sequence
  Description of Artificial Sequence: Synthetic polynucleotide
atgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 84 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 85 - DNA, 1425 bp, Artificial Sequence
  Description of Artificial Sequence: Synthetic polynucleotide
atgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 86 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcgcccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 87 - DNA, 1425 bp, Artificial Sequence
  Description of Artificial Sequence: Synthetic polynucleotide
atgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 88 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccggctgagccagagcggaggccagatgaagaagccaggagatagtatgaggattagttgtcgagcaagcgggtatgagtttatcaactgcccaattaattgggtgcgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 89 - DNA, 1425 bp, Artificial Sequence
  Description of Artificial Sequence: Synthetic polynucleotide
atgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 90 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtccagctgagccagagcggaggccagatgaagaagccaggagatagtatgaggattagttgtcgagcaagcgggtatgagtttatcaactgcccaattaattggatacgcctggcaccaggaaagcgacctgagtggatgggatggatgaaaccacgagggggagccgtgaactacgctcgacagctgcagggaagagtcaccatgacaagggacatgtattctgagaccgctttcctggaactgaggtctctgacaagtgacgatactgcagtctacttttgcacccggggcaagtattgtacagcaagagactactataactgggatttcgaacactggggacagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 91 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttcgtaattgtccaataaattggattcggctggcccccggaaaaaggcctgagtggatgggatggatgaagcctaggtggggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 92 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttcgtaattgtccaataaattggattcggctggcccccggaaaaaggcctgagtggatgggatggatgaagcctaggtggggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 93 - DNA, 1425 bp, Artificial Sequence
  Description of Artificial Sequence: Synthetic polynucleotide
atgggatggtcatgtatcatcctttttctagtagcaactgcaaccggtgtacattcccaggtgcagctggtgcagtctggaggtcagatgaagaagcctggcgagtcgatgagaatttcttgtcgggcttctggatatgaatttattgattgtccgattaattggattcgtctggcccccggaaaaaggcctgagtggatgggatggctgaagcctcggtggggggccgtcaactacgcacgtccacttcagggcagagtgaccatgactcgagacgtttattccgacacagcctttttggagctgcgctcgttgacagtagacgacacggccgtctacttttgtactaggggaaaatactgtaccgcgcgtgactattacaattgggacttcgaacactggggccggggcaccccggtcaccgtctcatcaccgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 94 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcccaggtgcagctggtgcagtctggaggtcagatgaagaagcctggcgagtcgatgagaatttcttgtcgggcttctggatatgaatttattgattgtccgattaattggattcgtctggcccccggaaaaaggcctgagtggatgggatggctgaagcctcggtggggggccgtcaactacgcacgtccacttcagggcagagtgaccatgactcgagacgtttattccgacacagcctttttggagctgcgctcgttgacagtagacgacacggccgtctacttttgtactaggggaaaatactgtaccgcgcgtgactattacaattgggacttcgaacactggggccggggcaccccggtcaccgtctcatcaccgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 95 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttcagaattgtccaataaattggattcggctggcccccggaaaaaggcctgagtggatgggatggatgaagcctaggtggggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 96 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttcagaattgtccaataaattggattcggctggcccccggaaaaaggcctgagtggatgggatggatgaagcctaggtggggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 97 - DNA, 1425 bp, Artificial Sequence; identical to SEQ ID NO: 91
  Description of Artificial Sequence: Synthetic polynucleotide

SEQ ID NO: 98 - DNA, 5838 bp, Artificial Sequence; identical to SEQ ID NO: 92
  Description of Artificial Sequence: Synthetic polynucleotide

SEQ ID NO: 99 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctaggtggggggccgtcaactacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 100 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctaggtggggggccgtcaactacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 101 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctaggttcggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 102 - protein, 474 aa, Artificial Sequence
  Description of Artificial Sequence: Synthetic polypeptide
MGWSCIILFLVATATGVHSQVRLSQSGGQMKKPGDSMRISCRASGYEFINCPINWIRLAPGKRPEWMGWMKPRFGAVSYARQLQGRVTMTRDMYSETAFLELRSLTSDDTAVYFCTRGKYCTARDYYNWDFEHWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctaggcggggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 104 - protein, 474 aa, Artificial Sequence [sequence omitted]

SEQ ID NO: 105 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctaggtggggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 106 - protein, 474 aa, Artificial Sequence
  Description of Artificial Sequence: Synthetic polypeptide
MGWSCIILFLVATATGVHSQVRLSQSGGQMKKPGDSMRISCRASGYEFINCPINWIRLAPGKRPEWMGWMKPRWGAVSYARQLQGRVTMTRDMYSETAFLELRSLTSDDTAVYFCTRGKYCTARDYYNWDFEHWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctaggtacggggccgtcagttacgcacgtcaacttcagggcagagtgaccatgactcgagacatgtattccgagacagcctttttggagctccgttccttgacatccgacgacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 108 - protein, 474 aa, Artificial Sequence
  Description of Artificial Sequence: Synthetic polypeptide
MGWSCIILFLVATATGVHSQVRLSQSGGQMKKPGDSMRISCRASGYEFINCPINWIRLAPGKRPEWMGWMKPRYGAVSYARQLQGRVTMTRDMYSETAFLELRSLTSDDTAVYFCTRGKYCTARDYYNWDFEHWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - DNA, 1425 bp, Artificial Sequence
  Description of Artificial Sequence: Synthetic polynucleotide
atgggatggtcttgtattattctgtttctggtcgcaaccgccacaggggtccactctcaggtgcagctgatgcagtccgggggtcagatgaagaaaccaggcgactcagtgaaggtcagctgcaaagcttccgggtacgagttcatcaactgtcccattaattgggtccggctggcaccaggacagagacctgaatggatgggatggatgaagccacgaggaggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 110 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcttgtattattctgtttctggtcgcaaccgccacaggggtccactctcaggtgcagctgatgcagtccgggggtcagatgaagaaaccaggcgactcagtgaaggtcagctgcaaagcttccgggtacgagttcatcaactgtcccattaattgggtccggctggcaccaggacagagacctgaatggatgggatggatgaagccacgaggaggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 111 - DNA, 690 bp, Artificial Sequence
  Description of Artificial Sequence: Synthetic polynucleotide
atgggatggtcatgtatcatcctttttctagtagcaactgcaaccggtgtacattcagagatcgtgctgacccagtcccccggcaccctgtccctgtcccccggcgagagggccaccatctcctgcaggacctcccagtacggctccctggcctggtaccagcagaagcccggccaggcccccaggctggtgatctactccggctccaccagggccgccggcatccccgacaggttctccggctccaggtccggccccgactacaccctgaccatctcctccctggagtccggcgacttcggcgtgtactactgccagcagtacgagttcttcggccccggcaccaaggtgcaggtggacatcaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 112 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagagatcgtgctgacccagtcccccggcaccctgtccctgtcccccggcgagagggccaccatctcctgcaggacctcccagtacggctccctggcctggtaccagcagaagcccggccaggcccccaggctggtgatctactccggctccaccagggccgccggcatccccgacaggttctccggctccaggtccggccccgactacaccctgaccatctcctccctggagtccggcgacttcggcgtgtactactgccagcagtacgagttcttcggccccggcaccaaggtgcaggtggacatcaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 113 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacaaatttattaattgtccaataaattggattcggctggcccccggaaaaaggcctgagtggatgggatggatgaagcctaggtggggggccgtcagttacgcacgtcaacttcagggcagagtgaccatgactcgagacatgtattccaagacagcctttttggagctccgttccttgacatccaaggacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 114 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacaaatttattaattgtccaataaattggattcggctggcccccggaaaaaggcctgagtggatgggatggatgaagcctaggtggggggccgtcagttacgcacgtcaacttcagggcagagtgaccatgactcgagacatgtattccaagacagcctttttggagctccgttccttgacatccaaggacacggccgtctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 115 - DNA, 690 bp, Artificial Sequence
  Description of Artificial Sequence: Synthetic polynucleotide
atgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacaccctcaccatcagcaacctgaagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 116 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacaccctcaccatcagcaacctgaagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 117 - DNA, 1425 bp, Artificial Sequence
  Description of Artificial Sequence: Synthetic polynucleotide
atgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctaggtggggggccgtcagttacgcacgtcaacttcagggcagagtgaccatgactcgagacatgtattccgagacagcccatttggagctccgttccttgacatccgacgacacggccacctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 118 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagaccaccatgggatggtcatgtatcatcctttttctagtagcaactgcaaccggtgtacattcccaggtgcgactgtcgcagtctggaggtcagatgaagaagcctggcgactcgatgagaatttcttgtcgggcttcgggatacgaatttattaattgtccaataaattggattcggctggcccccggaaaaaggcctgagtggatgggatggatgaagcctaggtggggggccgtcagttacgcacgtcaacttcagggcagagtgaccatgactcgagacatgtattccgagacagcccatttggagctccgttccttgacatccgacgacacggccacctatttttgtactcggggaaaatattgcactgcgcgcgactattataattgggacttcgaacactggggccagggcaccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 119 - DNA, 690 bp, Artificial Sequence
  Description of Artificial Sequence: Synthetic polynucleotide
atgggatggtcatgtatcatcctttttctagtagcaactgcaaccggtgtacattcagaaattgtgttgacacagtctccaggcaccctgtctttgtctccaggggaaacagccaccatctcttgtcggaccagtcagtatggttccttagcctggtatcaacagaggcccggccaggcccccaggctcgtcatctattcgggctctactcgggccgctggcatcccagacaggttcagcggcagtcggtcggggccagactacaccctcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 120 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagaaattgtgttgacacagtctccaggcaccctgtctttgtctccaggggaaacagccaccatctcttgtcggaccagtcagtatggttccttagcctggtatcaacagaggcccggccaggcccccaggctcgtcatctattcgggctctactcgggccgctggcatcccagacaggttcagcggcagtcggtcggggccagactacaccctcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 121 - DNA, 690 bp, Artificial Sequence
  Description of Artificial Sequence: Synthetic polynucleotide
atgggatggtcatgtatcatcctttttctagtagcaactgcaaccggtgtacattcagaaattgtgttgacacagtctccaggcaccctgtctttgtctccaggggaaacagccaccatctcttgtcggaccagtcagtatggttccttagcctggtatcaacagaggcccggccaggcccccaggctcgtcatctattcgggctctactcgggccgctggcatcccagacaggttcagcggcagtcggtcggggccagactacaccctcaccatcagcaacctggagtcgggagattttggtgtttattattgccagcagtatgaattttttggccaggggaccaaggtccagcaggacaataaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 122 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagaaattgtgttgacacagtctccaggcaccctgtctttgtctccaggggaaacagccaccatctcttgtcggaccagtcagtatggttccttagcctggtatcaacagaggcccggccaggcccccaggctcgtcatctattcgggctctactcgggccgctggcatcccagacaggttcagcggcagtcggtcggggccagactacaccctcaccatcagcaacctggagtcgggagattttggtgtttattattgccagcagtatgaattttttggccaggggaccaaggtccagcaggacaataaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 123 - DNA, 1425 bp, Artificial Sequence
  Description of Artificial Sequence: Synthetic polynucleotide
atgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcatcgactgcaccctgaactgggtgaggcaggcccccggccagaggcccgagtggatgggctggctgaagcccaggggcggcgccgtgaactacgccaggcccctgcagggcagggtgaccatgaccagggacgtgtactcctccaccgcctacatggagctgaggaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 124 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcatcgactgcaccctgaactgggtgaggcaggcccccggccagaggcccgagtggatgggctggctgaagcccaggggcggcgccgtgaactacgccaggcccctgcagggcagggtgaccatgaccagggacgtgtactcctccaccgcctacatggagctgaggaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 125 - DNA, 1425 bp, Artificial Sequence
  Description of Artificial Sequence: Synthetic polynucleotide
atgggatggtcatgtatcatcctttttctagtagcaactgcaaccggtgtacattcccaagtgcgactgtcgcagtctggaggtcagatgaagaagcctggcgagtcgatgagactttcctgtcgggcttccggatatgaatttctgaattgtccaataaattggattcgcctggcccccggaagacggcctgagtggatgggatggctgaagcctaggggaggggccgtcaattacgcacgtaaatttcagggcagagtgaccatgactcgagacgtgtattccgacacagcctttttggagttgcgctccttgacatcagacgacacggccgtctatttttgtactaggggaaaatattgtactgcgcgcgactattataattgggacttcgaacactggggccggggtgccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 126 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcccaagtgcgactgtcgcagtctggaggtcagatgaagaagcctggcgagtcgatgagactttcctgtcgggcttccggatatgaatttctgaattgtccaataaattggattcgcctggcccccggaagacggcctgagtggatgggatggctgaagcctaggggaggggccgtcaattacgcacgtaaatttcagggcagagtgaccatgactcgagacgtgtattccgacacagcctttttggagttgcgctccttgacatcagacgacacggccgtctatttttgtactaggggaaaatattgtactgcgcgcgactattataattgggacttcgaacactggggccggggtgccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 127 - DNA, 1425 bp, Artificial Sequence
  Description of Artificial Sequence: Synthetic polynucleotide
atgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcctgaactgccccatcaactgggtgaggcaggcccccggccagggcctggagtggatgggctggctgaagcccaggggcggcgccgtgaactacgccaggaagttccagggcagggtgaccatgaccagggacgtgtacatctccaccgcctacatggagctgtccaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 128 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcctgaactgccccatcaactgggtgaggcaggcccccggccagggcctggagtggatgggctggctgaagcccaggggcggcgccgtgaactacgccaggaagttccagggcagggtgaccatgaccagggacgtgtacatctccaccgcctacatggagctgtccaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 129 - DNA, 1425 bp, Artificial Sequence
  Description of Artificial Sequence: Synthetic polynucleotide
atgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcctgaactgccccatcaactgggtgaggcaggcccccggccagaggcccgagtggatgggctggctgaagcccaggggcggcgccgtgaactacgccaggaagttccagggcagggtgaccatgaccagggacgtgtactcctccaccgcctacatggagctgaggaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 130 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcctgaactgccccatcaactgggtgaggcaggcccccggccagaggcccgagtggatgggctggctgaagcccaggggcggcgccgtgaactacgccaggaagttccagggcagggtgaccatgaccagggacgtgtactcctccaccgcctacatggagctgaggaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 131 - DNA, 1425 bp, Artificial Sequence
  Description of Artificial Sequence: Synthetic polynucleotide
atgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcatcaactgccccatcaactgggtgaggcaggcccccggccagggcctggagtggatgggctggatgaagcccaggggcggcgccgtgtcctacgccaggcagctgcagggcagggtgaccatgaccagggacatgtacatctccaccgcctacatggagctgtccaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 132 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcatcaactgccccatcaactgggtgaggcaggcccccggccagggcctggagtggatgggctggatgaagcccaggggcggcgccgtgtcctacgccaggcagctgcagggcagggtgaccatgaccagggacatgtacatctccaccgcctacatggagctgtccaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 133 - DNA, 1425 bp, Artificial Sequence
  Description of Artificial Sequence: Synthetic polynucleotide
atgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcatcaactgccccatcaactgggtgaggcaggcccccggccagaggcccgagtggatgggctggatgaagcccaggggcggcgccgtgtcctacgccaggcagctgcagggcagggtgaccatgaccagggacatgtactcctccaccgcctacatggagctgaggaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 134 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcacaggtgcagctggtgcagtccggcgccgaggtgaagaagcccggcgcctccgtgaaggtgtcctgcaaggcctccggctacgagttcatcaactgccccatcaactgggtgaggcaggcccccggccagaggcccgagtggatgggctggatgaagcccaggggcggcgccgtgtcctacgccaggcagctgcagggcagggtgaccatgaccagggacatgtactcctccaccgcctacatggagctgaggaggctgaggtccgacgacaccgccgtgtactactgcgccaggggcaagtactgcaccgccagggactactacaactgggacttcgagcactggggccagggcaccctggtgaccgtgtcctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 135 - DNA, 690 bp, Artificial Sequence
  Description of Artificial Sequence: Synthetic polynucleotide
atgggatggtcatgtatcatcctttttctagtagcaactgcaaccggtgtacattcagagatcgtgctgacccagtcccccgccaccctgtccctgtcccccggcgagagggccaccctgtcctgcaggacctcccagtacggctccctggcctggtaccagcagaagcccggccaggcccccaggctggtgatctactccggctccaccagggccgccggcatccccgccaggttctccggctccaggtccggccccgactacaccctgaccatctcctccctggagtccggcgacttcgccgtgtactactgccagcagtacgagttcttcggccccggcaccaaggtgcaggtggacatcaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 136 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagagatcgtgctgacccagtcccccgccaccctgtccctgtcccccggcgagagggccaccctgtcctgcaggacctcccagtacggctccctggcctggtaccagcagaagcccggccaggcccccaggctggtgatctactccggctccaccagggccgccggcatccccgccaggttctccggctccaggtccggccccgactacaccctgaccatctcctccctggagtccggcgacttcgccgtgtactactgccagcagtacgagttcttcggccccggcaccaaggtgcaggtggacatcaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 137 - DNA, 690 bp, Artificial Sequence
  Description of Artificial Sequence: Synthetic polynucleotide
atgggatggtcatgtatcatcctttttctagtagcaactgcaaccggtgtacattcagagatcgtgctgacccagtcccccgccaccctgtccctgtcccccggcgagagggccaccatctcctgcaggacctcccagtacggctccctggcctggtaccagcagaagcccggccaggcccccaggctggtgatctactccggctccaccagggccgccggcatccccgccaggttctccggctccaggtccggccccgactacaccctgaccatctcctccctggagtccggcgacttcggcgtgtactactgccagcagtacgagttcttcggccccggcaccaaggtgcaggtggacatcaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 138 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagagatcgtgctgacccagtcccccgccaccctgtccctgtcccccggcgagagggccaccatctcctgcaggacctcccagtacggctccctggcctggtaccagcagaagcccggccaggcccccaggctggtgatctactccggctccaccagggccgccggcatccccgccaggttctccggctccaggtccggccccgactacaccctgaccatctcctccctggagtccggcgacttcggcgtgtactactgccagcagtacgagttcttcggccccggcaccaaggtgcaggtggacatcaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 139 - DNA, 690 bp, Artificial Sequence
  Description of Artificial Sequence: Synthetic polynucleotide
atgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacaccctcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 140 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacaccctcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 141 - DNA, 690 bp, Artificial Sequence
  Description of Artificial Sequence: Synthetic polynucleotide
atgggatggtcatgtatcatcctttttctagtagcaactgcaaccggtgtacattcagaaattgtgttgacacagtctccagccaccctgtctttgtctccaggggaaacagccatcatctcttgtcggaccagtcagtctggttccttagcctggtatcaacagaggcccggccaggcccccaggctcgtcatctattcgggttctactcgggccgctggcatcccagacaggttcagcggcagtcggtggggggcagactacaatctcagcatcagcaacctggagtcgggagattttggtgtttattattgtcagcagtatgaattttttggccaggggaccaaggtccaggtcgacattaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 142 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagaaattgtgttgacacagtctccagccaccctgtctttgtctccaggggaaacagccatcatctcttgtcggaccagtcagtctggttccttagcctggtatcaacagaggcccggccaggcccccaggctcgtcatctattcgggttctactcgggccgctggcatcccagacaggttcagcggcagtcggtggggggcagactacaatctcagcatcagcaacctggagtcgggagattttggtgtttattattgtcagcagtatgaattttttggccaggggaccaaggtccaggtcgacattaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 143 - DNA, 690 bp, Artificial Sequence
  Description of Artificial Sequence: Synthetic polynucleotide
atgggatggtcatgtatcatcctttttctagtagcaactgcaaccggtgtacattcagagatcgtgctgacccagtcccccgccaccctgtccctgtcccccggcgagagggccaccctgtcctgcaggacctcccagtccggctccctggcctggtaccagcagaagcccggccaggcccccaggctggtgatctactccggctccaccagggccgccggcatccccgccaggttctccggctccaggtccggcgccgactacaccctgaccatctcctccctggagtccggcgacttcgccgtgtactactgccagcagtacgagttcttcggccccggcaccaaggtgcaggtggacatcaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 144 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagagatcgtgctgacccagtcccccgccaccctgtccctgtcccccggcgagagggccaccctgtcctgcaggacctcccagtccggctccctggcctggtaccagcagaagcccggccaggcccccaggctggtgatctactccggctccaccagggccgccggcatccccgccaggttctccggctccaggtccggcgccgactacaccctgaccatctcctccctggagtccggcgacttcgccgtgtactactgccagcagtacgagttcttcggccccggcaccaaggtgcaggtggacatcaagcgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 145 - DNA, 1425 bp, Artificial Sequence
  Description of Artificial Sequence: Synthetic polynucleotide
atgggatggtcatgtatcattctgtttctggtcgctaccgctaccggagtgcatagtcaggtccagctggtccagtcaggagcacaggtgaagaaaccaggcgcttcagtgaaggtcagctgcaaagcatccgggtacgagttcatcaactgtcccattaattgggtccggcaggcaccaggacagagacctgaatggatgggatggatgaagccacgaggaggagccgtgtcttatgctaggcagctgcagggccgcgtcaccatgacacgagacatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 146 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggtcatgtatcattctgtttctggtcgctaccgctaccggagtgcatagtcaggtccagctggtccagtcaggagcacaggtgaagaaaccaggcgcttcagtgaaggtcagctgcaaagcatccgggtacgagttcatcaactgtcccattaattgggtccggcaggcaccaggacagagacctgaatggatgggatggatgaagccacgaggaggagccgtgtcttatgctaggcagctgcagggccgcgtcaccatgacacgagacatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 147 - DNA, 1425 bp, Artificial Sequence
  Description of Artificial Sequence: Synthetic polynucleotide
atgggatggtcttgtattattctgtttctggtcgcaaccgccacaggggtccactctcaggtgcagctggtccagtccggggctcaggtgaagaaaccaggcgactcagtgaaggtcagctgcaaagcttccgggtacgagttcatcaactgtcccattaattgggtccggctggcaccaggacagagacctgaatggatgggatggatgaagccacgaggaggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 148 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggtcttgtattattctgtttctggtcgcaaccgccacaggggtccactctcaggtgcagctggtccagtccggggctcaggtgaagaaaccaggcgactcagtgaaggtcagctgcaaagcttccgggtacgagttcatcaactgtcccattaattgggtccggctggcaccaggacagagacctgaatggatgggatggatgaagccacgaggaggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 149 - DNA, 1425 bp, Artificial Sequence
  Description of Artificial Sequence: Synthetic polynucleotide
atgggatggagctgtattattctgttcctggtggctaccgctaccggcgtgcattctcaggtccgactgtctcagagtggggggcagatgaagaaaccaggcgactcaatgcggatcagctgcagagcctccgggtacgagttcattaactgtcccatcaattggattcggctggctcccgggaagagacctgaatggatgggatggatgaaacctcgaggaggagcagcttctgcagcaaggcagctgcagggacgagtgaccatgacacgagatatgtatagcgagaccgccttcctggaactgaggtctctgacaagtgacgatactgctgtctacttttgcaccaggggcaagtattgtacagcacgcgactactataactgggattttgagcactggggacagggcactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 150 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggagctgtattattctgttcctggtggctaccgctaccggcgtgcattctcaggtccgactgtctcagagtggggggcagatgaagaaaccaggcgactcaatgcggatcagctgcagagcctccgggtacgagttcattaactgtcccatcaattggattcggctggctcccgggaagagacctgaatggatgggatggatgaaacctcgaggaggagcagcttctgcagcaaggcagctgcagggacgagtgaccatgacacgagatatgtatagcgagaccgccttcctggaactgaggtctctgacaagtgacgatactgctgtctacttttgcaccaggggcaagtattgtacagcacgcgactactataactgggattttgagcactggggacagggcactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 151 - DNA, 1425 bp, Artificial Sequence
  Description of Artificial Sequence: Synthetic polynucleotide
atgggctggtcttgtattatcctgtttctggtcgctaccgctactggcgtccattctcaggtccggctgtctcagtctggggggcagatgaagaaaccaggagactcaatgcggatcagctgcagagcttccggctacgagttcattaactgtcccatcaattggattcggctggcacccggcaagagacctgaatggatgggatggatgaaacctcgaggaggagcaggatctggcgctaggcagctgcagggacgagtgaccatgacacgagatatgtatagcgagaccgccttcctggaactgaggtctctgacaagtgacgatactgcagtctacttttgcaccaggggcaagtattgtacagcccgcgactactataactgggattttgagcactgggggcagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 152 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggctggtcttgtattatcctgtttctggtcgctaccgctactggcgtccattctcaggtccggctgtctcagtctggggggcagatgaagaaaccaggagactcaatgcggatcagctgcagagcttccggctacgagttcattaactgtcccatcaattggattcggctggcacccggcaagagacctgaatggatgggatggatgaaacctcgaggaggagcaggatctggcgctaggcagctgcagggacgagtgaccatgacacgagatatgtatagcgagaccgccttcctggaactgaggtctctgacaagtgacgatactgcagtctacttttgcaccaggggcaagtattgtacagcccgcgactactataactgggattttgagcactgggggcagggaactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 153 - DNA, 1425 bp, Artificial Sequence
  Description of Artificial Sequence: Synthetic polynucleotide
atgggatggtcatgtatcatcctttttctagtagcaactgcaaccggtgtacattcccaagtgcgactgtcgcagtctggaggtcagatgaagaagcctggcgagtcgatgagactttcctgtcgggcttccggatatgaatttctgaattgtccaataaattggattcgcctggcccccggaagacggcctgagtggatgggatggctgaagcctaggtttggggccgtcaattacgcacgtaaatttcagggcagagtgaccatgactcgagacgtgtattccgacacagcctttttggagttgcgctccttgacatcagacgacacggccgtctatttttgtactaggggaaaatattgtactgcgcgcgactattataattgggacttcgaacactggggccggggtgccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 154 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcccaagtgcgactgtcgcagtctggaggtcagatgaagaagcctggcgagtcgatgagactttcctgtcgggcttccggatatgaatttctgaattgtccaataaattggattcgcctggcccccggaagacggcctgagtggatgggatggctgaagcctaggtttggggccgtcaattacgcacgtaaatttcagggcagagtgaccatgactcgagacgtgtattccgacacagcctttttggagttgcgctccttgacatcagacgacacggccgtctatttttgtactaggggaaaatattgtactgcgcgcgactattataattgggacttcgaacactggggccggggtgccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 155 - DNA, 1425 bp, Artificial Sequence
  Description of Artificial Sequence: Synthetic polynucleotide
atgggatggtcatgtatcatcctttttctagtagcaactgcaaccggtgtacattcccaagtgcgactgtcgcagtctggaggtcagatgaagaagcctggcgagtcgatgagactttcctgtcgggcttccggatatgaatttctgaattgtccaataaattggattcgcctggcccccggaagacggcctgagtggatgggatggctgaagcctaggtggggggccgtcaattacgcacgtaaatttcagggcagagtgaccatgactcgagacgtgtattccgacacagcctttttggagttgcgctccttgacatcagacgacacggccgtctatttttgtactaggggaaaatattgtactgcgcgcgactattataattgggacttcgaacactggggccggggtgccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 156 - DNA, 5838 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcccaagtgcgactgtcgcagtctggaggtcagatgaagaagcctggcgagtcgatgagactttcctgtcgggcttccggatatgaatttctgaattgtccaataaattggattcgcctggcccccggaagacggcctgagtggatgggatggctgaagcctaggtggggggccgtcaattacgcacgtaaatttcagggcagagtgaccatgactcgagacgtgtattccgacacagcctttttggagttgcgctccttgacatcagacgacacggccgtctatttttgtactaggggaaaatattgtactgcgcgcgactattataattgggacttcgaacactggggccggggtgccccggtcaccgtctcgtcagcgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 157 - DNA, 690 bp, Artificial Sequence; identical to SEQ ID NO: 135
  Description of Artificial Sequence: Synthetic polynucleotide

SEQ ID NO: 158 - DNA, 5102 bp, Artificial Sequence; identical to SEQ ID NO: 136
  Description of Artificial Sequence: Synthetic polynucleotide

SEQ ID NO: 159 - DNA, 690 bp, Artificial Sequence; identical to SEQ ID NO: 137
  Description of Artificial Sequence: Synthetic polynucleotide

SEQ ID NO: 160 - DNA, 5102 bp, Artificial Sequence; identical to SEQ ID NO: 138
  Description of Artificial Sequence: Synthetic polynucleotide

SEQ ID NO: 161 - DNA, 1413 bp, Artificial Sequence
  Description of Artificial Sequence: Synthetic polynucleotide
atgggatggtcatgtatcatcctttttctagtagcaactgcaaccggtgtacattcccaggtgcagctggtgcagtctggaggtcagatgaagaagcctggcgagtcgatgagaatttcttgtcgggcttctggatatgaatttattgattgtacgctaaattggattcgtctggcccccggaaaaaggcctgagtggatgggatggctgaagcctcggttcggggccgtcaactacgcacgtccacttcagggcagagtgaccatgactcgagacgtttattccgacacagcctttttggagctgcgctcgttgacagtagacgacacggccgtctacttttgtactaggggaaaaaactgtgattacaattgggacttcgaacactggggccggggcaccccggtcatcgtctcatcaccgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 162 - DNA, 5826 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcccaggtgcagctggtgcagtctggaggtcagatgaagaagcctggcgagtcgatgagaatttcttgtcgggcttctggatatgaatttattgattgtacgctaaattggattcgtctggcccccggaaaaaggcctgagtggatgggatggctgaagcctcggttcggggccgtcaactacgcacgtccacttcagggcagagtgaccatgactcgagacgtttattccgacacagcctttttggagctgcgctcgttgacagtagacgacacggccgtctacttttgtactaggggaaaaaactgtgattacaattgggacttcgaacactggggccggggcaccccggtcatcgtctcatcaccgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 163 - DNA, 1413 bp, Artificial Sequence
  Description of Artificial Sequence: Synthetic polynucleotide
atgggatggtcatgtatcatcctttttctagtagcaactgcaaccggtgtacattcccaggtgcagctggtgcagtctggaggtcagatgaagaagcctggcgagtcgatgagaatttcttgtcgggcttctggatatgaatttattgattgtacgctaaattggattcgtctggcccccggaaaaaggcctgagtggatgggatggctgaagcctcggtggggggccgtcaactacgcacgtccacttcagggcagagtgaccatgactcgagacgtttattccgacacagcctttttggagctgcgctcgttgacagtagacgacacggccgtctacttttgtactaggggaaaaaactgtgattacaattgggacttcgaacactggggccggggcaccccggtcatcgtctcatcaccgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 164 - DNA, 5826 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcccaggtgcagctggtgcagtctggaggtcagatgaagaagcctggcgagtcgatgagaatttcttgtcgggcttctggatatgaatttattgattgtacgctaaattggattcgtctggcccccggaaaaaggcctgagtggatgggatggctgaagcctcggtggggggccgtcaactacgcacgtccacttcagggcagagtgaccatgactcgagacgtttattccgacacagcctttttggagctgcgctcgttgacagtagacgacacggccgtctacttttgtactaggggaaaaaactgtgattacaattgggacttcgaacactggggccggggcaccccggtcatcgtctcatcaccgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 165 - DNA, 690 bp, Artificial Sequence; identical to SEQ ID NO: 135
  Description of Artificial Sequence: Synthetic polynucleotide

SEQ ID NO: 166 - DNA, 5102 bp, Artificial Sequence; identical to SEQ ID NO: 136
  Description of Artificial Sequence: Synthetic polynucleotide

SEQ ID NO: 167 - DNA, 690 bp, Artificial Sequence; identical to SEQ ID NO: 137
  Description of Artificial Sequence: Synthetic polynucleotide

SEQ ID NO: 168 - DNA, 5102 bp, Artificial Sequence; identical to SEQ ID NO: 138
  Description of Artificial Sequence: Synthetic polynucleotide

SEQ ID NO: 169 - DNA, 690 bp, Artificial Sequence
  Description of Artificial Sequence: Synthetic polynucleotide
atgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacgaactcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 170 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacgaactcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 171 - DNA, 690 bp, Artificial Sequence
  Description of Artificial Sequence: Synthetic polynucleotide
atgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactactttctcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 172 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactactttctcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 173 - DNA, 690 bp, Artificial Sequence
  Description of Artificial Sequence: Synthetic polynucleotide
atgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactactctctcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 174 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactactctctcaccatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 175 - DNA, 690 bp, Artificial Sequence
  Description of Artificial Sequence: Synthetic polynucleotide
atgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacaatctcatcatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctga

SEQ ID NO: 176 - DNA, 5102 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaccatgggatggtcatgtatcatcctttttctagtagcaactgcaaccggtgtacattcagaaattgtgttgacacagtctccaggcaccctgtctttgtctccaggggaaacagccatcatctcttgtcggaccagtcagtatggttccttagcctggtatcaacagaggcccggccaggcccccaggctcgtcatctattcgggctctactcgggccgctggcatcccagacaggttcagcggcagtcggtgggggccagactacaatctcatcatcagcaacctggagtcgggagattttggtgtttattattgccagcagtatgaattttttggccaggggaccaaggtccaggtcgacattaaacgtacggtggctgcaccatctgtcttcatcttcccgccatctgatgagcagttgaaatctggaactgcctctgttgtgtgcctgctgaataacttctaccccagagaagccaaagtgcagtggaaggtggacaacgccctgcagagcggaaacagccaggaaagcgtgacagagcaggattccaaggattccacatacagcctgagcagcacactgacactgtccaaggccgactacgagaagcacaaggtgtacgcctgcgaagtgacacaccagggactgtcctcccctgtgacaaagagcttcaacagaggagaatgctgataggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 177 - DNA, 1425 bp, Artificial Sequence
  Description of Artificial Sequence: Synthetic polynucleotide
atgggatggagctgtattattctgttcctggtggctaccgctaccggcgtgcattctcaggtccgactgtctcagagtggggggcagatgaagaaaccaggcgactcaatgcggatcagctgcagagcctccgggtacgagttcattaactgtcccatcaattggattcggctggctcccgggaagagacctgaatggatgggatggatgaaacctcgatttggagcagcttctgcagcaaggcagctgcagggacgagtgaccatgacacgagatatgtatagcgagaccgccttcctggaactgaggtctctgacaagtgacgatactgctgtctacttttgcaccaggggcaagtattgtacagcacgcgactactataactgggattttgagcactggggacagggcactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 178 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggagctgtattattctgttcctggtggctaccgctaccggcgtgcattctcaggtccgactgtctcagagtggggggcagatgaagaaaccaggcgactcaatgcggatcagctgcagagcctccgggtacgagttcattaactgtcccatcaattggattcggctggctcccgggaagagacctgaatggatgggatggatgaaacctcgatttggagcagcttctgcagcaaggcagctgcagggacgagtgaccatgacacgagatatgtatagcgagaccgccttcctggaactgaggtctctgacaagtgacgatactgctgtctacttttgcaccaggggcaagtattgtacagcacgcgactactataactgggattttgagcactggggacagggcactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 179 - DNA, 1425 bp, Artificial Sequence
  Description of Artificial Sequence: Synthetic polynucleotide
atgggatggagctgtattattctgttcctggtggctaccgctaccggcgtgcattctcaggtccgactgtctcagagtggggggcagatgaagaaaccaggcgactcaatgcggatcagctgcagagcctccgggtacgagttcattaactgtcccatcaattggattcggctggctcccgggaagagacctgaatggatgggatggatgaaacctcgatggggagcagcttctgcagcaaggcagctgcagggacgagtgaccatgacacgagatatgtatagcgagaccgccttcctggaactgaggtctctgacaagtgacgatactgctgtctacttttgcaccaggggcaagtattgtacagcacgcgactactataactgggattttgagcactggggacagggcactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 180 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggagctgtattattctgttcctggtggctaccgctaccggcgtgcattctcaggtccgactgtctcagagtggggggcagatgaagaaaccaggcgactcaatgcggatcagctgcagagcctccgggtacgagttcattaactgtcccatcaattggattcggctggctcccgggaagagacctgaatggatgggatggatgaaacctcgatggggagcagcttctgcagcaaggcagctgcagggacgagtgaccatgacacgagatatgtatagcgagaccgccttcctggaactgaggtctctgacaagtgacgatactgctgtctacttttgcaccaggggcaagtattgtacagcacgcgactactataactgggattttgagcactggggacagggcactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 181 - DNA, 1425 bp, Artificial Sequence
  Description of Artificial Sequence: Synthetic polynucleotide
atgggatggagctgtattattctgttcctggtggctaccgctaccggcgtgcattctcaggtccgactgtctcagagtggggggcagatgaagaaaccaggcgactcaatgcggatcagctgcagagcctccgggtacgagttcattaactgtcccatcaattggattcggctggctcccgggaagagacctgaatggatgggatggatgaaacctcgatatggagcagcttctgcagcaaggcagctgcagggacgagtgaccatgacacgagatatgtatagcgagaccgccttcctggaactgaggtctctgacaagtgacgatactgctgtctacttttgcaccaggggcaagtattgtacagcacgcgactactataactgggattttgagcactggggacagggcactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 182 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggagctgtattattctgttcctggtggctaccgctaccggcgtgcattctcaggtccgactgtctcagagtggggggcagatgaagaaaccaggcgactcaatgcggatcagctgcagagcctccgggtacgagttcattaactgtcccatcaattggattcggctggctcccgggaagagacctgaatggatgggatggatgaaacctcgatatggagcagcttctgcagcaaggcagctgcagggacgagtgaccatgacacgagatatgtatagcgagaccgccttcctggaactgaggtctctgacaagtgacgatactgctgtctacttttgcaccaggggcaagtattgtacagcacgcgactactataactgggattttgagcactggggacagggcactcccgtgaccgtcagctccccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 183 - DNA, 1425 bp, Artificial Sequence
  Description of Artificial Sequence: Synthetic polynucleotide
atgggatggtcatgtatcattctgtttctggtcgctaccgctaccggagtgcatagtcaggtccagctggtccagtcaggagcacaggtgaagaaaccaggcgcttcagtgaaggtcagctgcaaagcatccgggtacgagttcatcaactgtcccattaattgggtccggcaggcaccaggacagagacctgaatggatgggatggatgaagccacgatttggagccgtgtcttatgctaggcagctgcagggccgcgtcaccatgacacgagacatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 184 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggtcatgtatcattctgtttctggtcgctaccgctaccggagtgcatagtcaggtccagctggtccagtcaggagcacaggtgaagaaaccaggcgcttcagtgaaggtcagctgcaaagcatccgggtacgagttcatcaactgtcccattaattgggtccggcaggcaccaggacagagacctgaatggatgggatggatgaagccacgatttggagccgtgtcttatgctaggcagctgcagggccgcgtcaccatgacacgagacatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 185 - DNA, 1425 bp, Artificial Sequence
  Description of Artificial Sequence: Synthetic polynucleotide
atgggatggtcatgtatcattctgtttctggtcgctaccgctaccggagtgcatagtcaggtccagctggtccagtcaggagcacaggtgaagaaaccaggcgcttcagtgaaggtcagctgcaaagcatccgggtacgagttcatcaactgtcccattaattgggtccggcaggcaccaggacagagacctgaatggatgggatggatgaagccacgatggggagccgtgtcttatgctaggcagctgcagggccgcgtcaccatgacacgagacatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 186 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggtcatgtatcattctgtttctggtcgctaccgctaccggagtgcatagtcaggtccagctggtccagtcaggagcacaggtgaagaaaccaggcgcttcagtgaaggtcagctgcaaagcatccgggtacgagttcatcaactgtcccattaattgggtccggcaggcaccaggacagagacctgaatggatgggatggatgaagccacgatggggagccgtgtcttatgctaggcagctgcagggccgcgtcaccatgacacgagacatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 187 - DNA, 1425 bp, Artificial Sequence
  Description of Artificial Sequence: Synthetic polynucleotide
atgggatggtcatgtatcattctgtttctggtcgctaccgctaccggagtgcatagtcaggtccagctggtccagtcaggagcacaggtgaagaaaccaggcgcttcagtgaaggtcagctgcaaagcatccgggtacgagttcatcaactgtcccattaattgggtccggcaggcaccaggacagagacctgaatggatgggatggatgaagccacgatatggagccgtgtcttatgctaggcagctgcagggccgcgtcaccatgacacgagacatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 188 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggtcatgtatcattctgtttctggtcgctaccgctaccggagtgcatagtcaggtccagctggtccagtcaggagcacaggtgaagaaaccaggcgcttcagtgaaggtcagctgcaaagcatccgggtacgagttcatcaactgtcccattaattgggtccggcaggcaccaggacagagacctgaatggatgggatggatgaagccacgatatggagccgtgtcttatgctaggcagctgcagggccgcgtcaccatgacacgagacatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 189 - DNA, 1425 bp, Artificial Sequence
  Description of Artificial Sequence: Synthetic polynucleotide
atgggatggtcttgtattattctgtttctggtcgcaaccgccacaggggtccactctcaggtgcagctggtccagtccggggctcaggtgaagaaaccaggcgactcagtgaaggtcagctgcaaagcttccgggtacgagttcatcaactgtcccattaattgggtccggctggcaccaggacagagacctgaatggatgggatggatgaagccacgatttggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 190 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggtcttgtattattctgtttctggtcgcaaccgccacaggggtccactctcaggtgcagctggtccagtccggggctcaggtgaagaaaccaggcgactcagtgaaggtcagctgcaaagcttccgggtacgagttcatcaactgtcccattaattgggtccggctggcaccaggacagagacctgaatggatgggatggatgaagccacgatttggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 191 - DNA, 1425 bp, Artificial Sequence
  Description of Artificial Sequence: Synthetic polynucleotide
atgggatggtcttgtattattctgtttctggtcgcaaccgccacaggggtccactctcaggtgcagctggtccagtccggggctcaggtgaagaaaccaggcgactcagtgaaggtcagctgcaaagcttccgggtacgagttcatcaactgtcccattaattgggtccggctggcaccaggacagagacctgaatggatgggatggatgaagccacgatggggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 192 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggtcttgtattattctgtttctggtcgcaaccgccacaggggtccactctcaggtgcagctggtccagtccggggctcaggtgaagaaaccaggcgactcagtgaaggtcagctgcaaagcttccgggtacgagttcatcaactgtcccattaattgggtccggctggcaccaggacagagacctgaatggatgggatggatgaagccacgatggggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 193 - DNA, 1425 bp, Artificial Sequence
  Description of Artificial Sequence: Synthetic polynucleotide
atgggatggtcttgtattattctgtttctggtcgcaaccgccacaggggtccactctcaggtgcagctggtccagtccggggctcaggtgaagaaaccaggcgactcagtgaaggtcagctgcaaagcttccgggtacgagttcatcaactgtcccattaattgggtccggctggcaccaggacagagacctgaatggatgggatggatgaagccacgatatggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 194 - DNA, 5837 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcctcgacacgtgtgatcagatatcgcggccgctctagacaccatgggatggtcttgtattattctgtttctggtcgcaaccgccacaggggtccactctcaggtgcagctggtccagtccggggctcaggtgaagaaaccaggcgactcagtgaaggtcagctgcaaagcttccgggtacgagttcatcaactgtcccattaattgggtccggctggcaccaggacagagacctgaatggatgggatggatgaagccacgatatggagccgtgtcttatgctaggcagctgcagggccgcgtcaccatgacacgagatatgtacagctccaccgcctatctggagctgcggagactgacaagcgacgatactgcagtgtactattgcgccaggggcaaatactgtacagctcgcgactactataactgggattttgaacactggggacagggcactctggtgaccgtctctagtccgtcgaccaagggcccatcggtcttccccctggcaccctcctccaagagcacctctgggggcacagcggccctgggctgcctggtcaaggactacttccccgaacccgtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 195 - protein, 98 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAR

SEQ ID NO: 196 - protein, 125 aa, Homo sapiens
QVRLSQSGGQMKKPGESMRLSCRASGYEFLNCPINWIRLAPGRRPEWMGWLKPRGGAVNYARKFQGRVTMTRDVYSDTAFLELRSLTSDDTAVYFCTRGKYCTARDYYNWDFEHWGRGAPVTVSS

SEQ ID NO: 197 - protein, 121 aa, Homo sapiens
QVQLVQSGGQMKKPGESMRISCQASGYEFIDCTLNWVRLAPGRRPEWMGWLKPRGGAVNYARPLQGRVTMTRDVYSDTAFLELRSLTADDTAVYYCTRGKNCDYNWDFEHWGRGTPVTVSS

SEQ ID NO: 198 - protein, 121 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGKNCDYNWDFEHWGRGTPVIVSS

SEQ ID NO: 199 - protein, 144 aa, Homo sapiens
MGWSCIILFLVATATGVHSQVQLVQSGAEVKKPGASVKVSCKASGYEFIDCTLNWVRQAPGQRPEWMGWLKPRGGAVNYARPLQGRVTMTRDVYSSTAYMELRRLRSDDTAVYYCARGKYCTARDYYNWDFEHWGQGTLVTVSS

SEQ ID NO: 200 - protein, 144 aa, Homo sapiens
MGWSCIILFLVATATGVHSQVQLVQSGAEVKKPGASVKVSCKASGYEFLNCPINWVRQAPGQGLEWMGWLKPRGGAVNYARKFQGRVTMTRDVYISTAYMELSRLRSDDTAVYYCARGKYCTARDYYNWDFEHWGQGTLVTVSS

SEQ ID NO: 201 - protein, 125 aa, Homo sapiens
QVQLVQSGAEVKKPGASVKVSCKASGYEFLNCPINWVRQAPGQRPEWMGWLKPRGGAVNYARKFQGRVTMTRDVYSSTAYMELRRLRSDDTAVYYCARGKYCTARDYYNWDFEHWGQGTLVTVSS

SEQ ID NO: 202 - protein, 125 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGKYCTARDYYNWDFEHWGQGTPVTVSS

SEQ ID NO: 203 - protein, 125 aa, Homo sapiens
QVQLVQSGAEVKKPGASVKVSCKASGYEFINCPINWVRQAPGQGLEWMGWMKPRGGAVSYARQLQGRVTMTRDMYISTAYMELSRLRSDDTAVYYCARGKYCTARDYYNWDFEHWGQGTLVTVSS

SEQ ID NO: 204 - protein, 125 aa, Homo sapiens
QVQLVQSGAEVKKPGASVKVSCKASGYEFINCPINWVRQAPGQRPEWMGWMKPRGGAVSYARQLQGRVTMTRDMYSSTAYMELRRLRSDDTAVYYCARGKYCTARDYYNWDFEHWGQGTLVTVSS

SEQ ID NO: 205 - protein, 125 aa, Homo sapiens
QVQLVQSGAQVKKPGASVKVSCKASGYEFINCPINWVRQAPGQRPEWMGWMKPRGGAVSYARQLQGRVTMTRDMYSSTAYLELRRLTSDDTAVYYCARGKYCTARDYYNWDFEHWGQGTLVTVSS

SEQ ID NO: 206 - protein, 125 aa, Homo sapiens
QVQLVQSGAQVKKPGDSVKVSCKASGYEFINCPINWVRLAPGQRPEWMGWMKPRGGAVSYARQLQGRVTMTRDMYSSTAYLELRRLTSDDTAVYYCARGKYCTARDYYNWDFEHWGQGTLVTVSS

SEQ ID NO: 207 - protein, 125 aa, Homo sapiens
QVQLMQSGGQMKKPGDSVKVSCKASGYEFINCPINWVRLAPGQRPEWMGWMKPRGGAVSYARQLQGRVTMTRDMYSSTAYLELRRLTSDDTAVYYCARGKYCTARDYYNWDFEHWGQGTLVTVSS

SEQ ID NO: 208 - protein, 105 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQYEFFGQGTKVQVDIK

SEQ ID NO: 209 - protein, 102 aa, Homo sapiens
EIVLTQSPATLSLSPGERATLSCRTSQYGSLAWYQQKPGQAPRLVIYSGSTRAAGIPARFSGSSGPDYTLTISSLEPEDFAVYYCQQYEFFGPGTKVQVDIK

SEQ ID NO: 210 - protein, 103 aa, Homo sapiens
EIVLTQSPATLSLSPGERATLSCRTSQYGSLAWYQQKPGQAPRLVIYSGSTRAAGIPARFSGSRSGPDYTLTISSLESGDFAVYYCQQYEFFGPGTKVQVDIK

SEQ ID NO: 211 - protein, 103 aa, Homo sapiens
EIVLTQSPATLSLSPGERATISCRTSQYGSLAWYQQKPGQAPRLVIYSGSTRAAGIPARFSGSRSGPDYTLTISSLESGDFGVYYCQQYEFFGPGTKVQVDIK

SEQ ID NO: 212 - protein, 103 aa, Homo sapiens
EIVLTQSPGTLSLSPGETAIISCRTSQYGSLAWYQQRPGQAPRLVIYSGSTRAAGIPDRFSGSRWGPDYTLTISNLESGDFGVYYCQQYEFFGQGTKVQVDIK

SEQ ID NO: 213 - protein, 103 aa, Homo sapiens; identical to SEQ ID NO: 51

SEQ ID NO: 214 - protein, 103 aa, Homo sapiens
EIVLTQSPATLSLSPGERATLSCRTSQSGSLAWYQQKPGQAPRLVIYSGSTRAAGIPARFSGSRSGADYTLTISSLESGDFAVYYCQQYEFFGPGTKVQVDIK

SEQ ID NO: 215 - protein, 103 aa, Homo sapiens
EIVLTQSPATLSLSPGETAIISCRTSQSGSLAWYQQRPGQAPRLVIYSGSTRAAGIPDRFSGSRWGADYNLSISNLESGDFGVYYCQQYEFFGQGTKVQVDIK

SEQ ID NO: 216 - protein, 125 aa, Homo sapiens
QVQLSQSGGQMKKPGDSMRVSCKASGYEFINCPINWVRLAPGQRPEWMGWMKPRGGAVSYARQLQGRVTMTRDMYSSTAYLELRRLTSDDTAVYYCARGKYCTARDYYNWDFEHWGQGTPVTVSS

SEQ ID NO: 217 - protein, 125 aa, Homo sapiens
QVQLSQSGGQMKKPGDSMRISCKASGYEFINCPINWVRLAPGQRPEWMGWMKPRGGAVSYARQLQGRVTMTRDMYSSTAYLELRSLTSDDTAVYYCARGKYCTARDYYNWDFEHWGQGTPVTVSS

SEQ ID NO: 218 - protein, 125 aa, Homo sapiens; identical to SEQ ID NO: 39

SEQ ID NO: 219 - protein, 101 aa, Homo sapiens
ELTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 220 - protein, 101 aa, Homo sapiens
KLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 221 - protein, 101 aa, Homo sapiens
SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 222 - protein, 101 aa, Homo sapiens
VLTQSPGTLSLSPGETAIISCRTSQYGSLAWYQQRPGQAPRLVIYSGSTRAAGIPDRFSGSRWGPDYNLTISNLESGDFGVYYCQQYEDFGQGTKVQVDIK

SEQ ID NO: 223 - protein, 101 aa, Homo sapiens
VLTQSPGTLSLSPGETAIISCRTSQYGSLAWYQQRPGQAPRLVIYSGSTRAAGIPDRFSGSRWGPDYNLTISNLESGDFGVYYCQQYEKFGQGTKVQVDIK

SEQ ID NO: 224 - protein, 101 aa, Homo sapiens
VLTQSPGTLSLSPGETAIISCRTSQYGSLAWYQQRPGQAPRLVIYSGSTRAAGIPDRFSGSRWGPDYNLTISNLESGDFGVYYCQQYESFGQGTKVQVDIK

SEQ ID NO: 225 - protein, 101 aa, Homo sapiens
VLTQSPGTLSLSPGETAIISCRTSQYGSLAWYQQRPGQAPRLVIYSGSTRAAGIPDRFSGSRWGPDYNLTISNLESGDFGVYYCQQYEHFGQGTKVQVDIK

SEQ ID NO: 226 - protein, 101 aa, Homo sapiens
ELTQSPGTLSLSPGETAIISCRTSQYGSLAWYQQRPGQAPRLVIYSGSTRAAGIPDRFSGSRWGPDYNLTISNLESGDFGVYYCQQYESFGQGTKVQVDIK

SEQ ID NO: 227 - protein, 101 aa, Homo sapiens
ELTQSPGTLSLSPGETAIISCRTSQYGSLAWYQQRPGQAPRLVIYSGSTRAAGIPDRFSGSRWGPDYNLTISNLESGDFGVYYCQQYEHFGQGTKVQVDIK

SEQ ID NO: 228 - protein, 103 aa, Homo sapiens
EIVLTQSPGTLSLSPGETAIISCRTSQYGSLAWYQQRPGQAPRLVIYSGSTRAAGIPDRFSGSRSGPDYTLTISNLESGDFGVYYCQQYEFFGQGTKVQVDIK

SEQ ID NO: 229 - protein, 103 aa, Homo sapiens
EIVLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQVDIK

SEQ ID NO: 230 - protein, 103 aa, Homo sapiens
EIVLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQQDNK

SEQ ID NO: 231 - protein, 103 aa, Homo sapiens
EIVLTQSPGTLSLSPGETAEISCRTSQYGSLAWYQQRPGQAPRLVIYSGSTRAAGIPDRFKGEREGPEYRLRISNLESGDFGVYYCQQYEFFGQGTKVQQDNK

SEQ ID NO: 232 - protein, 101 aa, Homo sapiens
SLTQSPGTLSLSPGETATISCRTSQYGSLAWYQQRPGQAPRLVIYSGSTRAAGIPDRFSGSRSGPDYTLTISNLESGDFGVYYCQQYEFFGQGTKVQQDNK

SEQ ID NO: 233 - protein, 101 aa, Homo sapiens
SLTQSPGTLSLSPGETAIISCRTSQYGSLAWYQQRPGQAPRLVIYSGSTRAAGIPDRFSGSRSGPDYTLTISNLESGDFGVYYCQQYEFFGQGTKVQVDIK

SEQ ID NO: 234 - protein, 101 aa, Homo sapiens
SLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQVDIK

SEQ ID NO: 235 - protein, 101 aa, Homo sapiens
SLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQQDNK

SEQ ID NO: 236 - protein, 101 aa, Homo sapiens
SLTQSPGTLSLSPGETAEISCRTSQYGSLAWYQQRPGQAPRLVIYSGSTRAAGIPDRFKGEREGPEYRLRISNLESGDFGVYYCQQYEFFGQGTKVQQDNK

SEQ ID NO: 237 - protein, 101 aa, Homo sapiens
ELTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQVDIK

SEQ ID NO: 238 - protein, 103 aa, Artificial sequence
  Consensus sequence
  MISC_FEATURE (1)..(1): E or no amino acid
  MISC_FEATURE (2)..(2): I or no amino acid
  MISC_FEATURE (3)..(3): V, E, K, or S
  MISC_FEATURE (20)..(20): I, Q, E, or T
  MISC_FEATURE (61)..(61): S or K
  MISC_FEATURE (63)..(63): S or E
  MISC_FEATURE (65)..(65): W, S, N, or E
  MISC_FEATURE (68)..(68): D or E
  MISC_FEATURE (70)..(70): N, T, or R
  MISC_FEATURE (72)..(72): T or R
  MISC_FEATURE (91)..(91): F, D, K, S, or H
  MISC_FEATURE (100)..(100): V or Q
  MISC_FEATURE (102)..(102): I or N
XXXLTQSPGTLSLSPGETAXISCRTSQYGSLAWYQQRPGQAPRLVIYSGSTRAAGIPDRFXGXRXGPXYXLXISNLESGDFGVYYCQQYEXFGQGTKVQXDXK

SEQ ID NO: 239 - protein, 210 aa, Homo sapiens
EIELTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 240 - protein, 210 aa, Homo sapiens
EIKLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 241 - protein, 210 aa, Homo sapiens
EISLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 242 - protein, 210 aa, Homo sapiens
EIVLTQSPGTLSLSPGETAIISCRTSQYGSLAWYQQRPGQAPRLVIYSGSTRAAGIPDRFSGSRWGPDYNLTISNLESGDFGVYYCQQYEDFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 243 - protein, 210 aa, Homo sapiens
EIVLTQSPGTLSLSPGETAIISCRTSQYGSLAWYQQRPGQAPRLVIYSGSTRAAGIPDRFSGSRWGPDYNLTISNLESGDFGVYYCQQYEKFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 244 - protein, 210 aa, Homo sapiens
EIVLTQSPGTLSLSPGETAIISCRTSQYGSLAWYQQRPGQAPRLVIYSGSTRAAGIPDRFSGSRWGPDYNLTISNLESGDFGVYYCQQYESFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 245 - protein, 210 aa, Homo sapiens
EIVLTQSPGTLSLSPGETAIISCRTSQYGSLAWYQQRPGQAPRLVIYSGSTRAAGIPDRFSGSRWGPDYNLTISNLESGDFGVYYCQQYEHFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 246 - protein, 210 aa, Homo sapiens
EIELTQSPGTLSLSPGETAIISCRTSQYGSLAWYQQRPGQAPRLVIYSGSTRAAGIPDRFSGSRWGPDYNLTISNLESGDFGVYYCQQYESFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 247 - protein, 210 aa, Homo sapiens
EIELTQSPGTLSLSPGETAIISCRTSQYGSLAWYQQRPGQAPRLVIYSGSTRAAGIPDRFSGSRWGPDYNLTISNLESGDFGVYYCQQYEHFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - protein, 210 aa, Homo sapiens
EIVLTQSPGTLSLSPGETAIISCRTSQYGSLAWYQQRPGQAPRLVIYSGSTRAAGIPDRFSGSRSGPDYTLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - protein, 210 aa, Homo sapiens
EIVLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 250 - protein, 210 aa, Homo sapiens
EIVLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQQDNKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 251 - protein, 210 aa, Homo sapiens
EIVLTQSPGTLSLSPGETAEISCRTSQYGSLAWYQQRPGQAPRLVIYSGSTRAAGIPDRFKGEREGPEYRLRISNLESGDFGVYYCQQYEFFGQGTKVQQDNKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 252 - protein, 208 aa, Homo sapiens
SLTQSPGTLSLSPGETATISCRTSQYGSLAWYQQRPGQAPRLVIYSGSTRAAGIPDRFSGSRSGPDYTLTISNLESGDFGVYYCQQYEFFGQGTKVQQDNKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 253 - protein, 208 aa, Homo sapiens
SLTQSPGTLSLSPGETAIISCRTSQYGSLAWYQQRPGQAPRLVIYSGSTRAAGIPDRFSGSRSGPDYTLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 254 - protein, 208 aa, Homo sapiens
SLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 255 - protein, 208 aa, Homo sapiens
SLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQQDNKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 256 - protein, 208 aa, Homo sapiens
SLTQSPGTLSLSPGETAEISCRTSQYGSLAWYQQRPGQAPRLVIYSGSTRAAGIPDRFKGEREGPEYRLRISNLESGDFGVYYCQQYEFFGQGTKVQQDNKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - protein, 208 aa, Homo sapiens
ELTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 258 - protein, 125 aa, Homo sapiens
QVRLSQSGGQMKKPGDSMRISCRASGYEFINCPINWIRLAPGKRPEWMGWMKPRHGAVNYARQLQGRVTMTRDMYSETAFLELRSLTSDDTAVYFCTRGKYCTARDYYNWDFEHWGQGTPVTVSS

SEQ ID NO: 259 - protein, 125 aa, Homo sapiens
QVRLSQSGGQMKKPGDSMRISCRASGYEFINCPINWVRLAPGKRPEWMGWMKPRHGAVSYARQLQGRVTMTRDMYSETAFLELRSLTSDDTAVYFCARGKYCTARDYYNWDFEHWGQGTPVTVSS

SEQ ID NO: 260 - protein, 125 aa, Homo sapiens
QVRLSQSGGQMKKPGDSMRISCRASGYEFINCPINWVRLAPGKRPEWMGWMKPRHGAVNYARQLQGRVTMTRDMYSETAFLELRSLTSDDTAVYFCARGKYCTARDYYNWDFEHWGQGTPVTVSS

We claim:

1. An isolated monoclonal antibody comprising:
   a heavy chain variable domain comprising a heavy chain complementary determining region (HCDR)1, a HCDR2, and HCDR3 comprising amino acids 26-33, 51-58, and 97-114 of SEQ ID NO: 40, respectively; and
   a light chain variable domain comprising a light chain complementary determining region (LCDR)1, a LCDR2, and a LCDR3 comprising amino acids 27-30, 48-50, and 87-91 of SEQ NO: 238, respectively, wherein
   the antibody specifically binds a CD4 binding site on human immunodeficiency virus type 1 (HIV-1) gp120 and neutralizes HIV-1.

2. The isolated monoclonal antibody of claim 1, wherein the heavy chain variable domain comprises one of:
   (a) amino acids 26-33 (CDR1), 51-58 (CDR2) and 97-114 (CDR3) of SEQ ID NO: 40, wherein $X_2$ is G; or
   (b) amino acids 26-33 (CDR1), 51-58 (CDR2) and 97-114 (CDR3) of SEQ ID NO: 40, wherein $X_2$ is H.

3. The isolated monoclonal antibody of claim 1, wherein the heavy chain variable domain of the antibody comprises SEQ ID NO: 40.

4. The isolated monoclonal antibody of claim 1, wherein the heavy chain variable domain of the antibody comprises one of:
   (a) SEQ ID NO: 40, wherein $X_1$ is I, $X_2$ is G, $X_3$ is S and $X_4$ is T (VRC07; SEQ ID NO: 2);
   (b) SEQ ID NO: 40, wherein $X_1$ is I, $X_2$ is H, $X_3$ is S and $X_4$ is T (VRC07 G54H; SEQ ID NO: 32);
   (c) SEQ ID NO: 40, wherein $X_1$ is I, $X_2$ is H, $X_3$ is N and $X_4$ is T (VRC07 G54H, S58N; SEQ ID NO: 258);
   (d) SEQ ID NO: 40, wherein $X_1$ is V, $X_2$ is H, $X_3$ is S and $X_4$ is A (VRC07 I37V, G54H, T93A; SEQ ID NO: 259); or
   (e) SEQ ID NO: 40, wherein $X_1$ is V, $X_2$ is H, $X_3$ is N and $X_4$ is A (VRC07 I37V, G54H, S58N, T93A; SEQ ID NO: 260).

5. The isolated monoclonal antibody claim 1, wherein the light chain variable domain comprises one of:
   (a) amino acids 27-30 (CDR1), 48-50 (CDR2) and 87-91 (CDR3) of SEQ ID NO: 238, wherein $X_{11}$ is F (VRC01 light chain CDRs);
   (b) amino acids 27-30 (CDR1), 48-50 (CDR2) and 87-91 (CDR3) of SEQ ID NO: 238, wherein $X_{11}$ is D (VRC01 light chain CDRs with F97D);
   (c) amino acids 27-30 (CDR1), 48-50 (CDR2) and 87-91 (CDR3) of SEQ ID NO: 238, wherein $X_{11}$ is K (VRC01 light chain CDRs with F97K);
   (d) amino acids 27-30 (CDR1), 48-50 (CDR2) and 87-91 (CDR3) of SEQ ID NO: 238, wherein $X_{11}$ is S (VRC01 light chain CDRs with F97S); or
   (e) amino acids 27-30 (CDR1), 48-50 (CDR2) and 87-91 (CDR3) of SEQ ID NO: 238, wherein $X_{11}$ is H (VRC01 light chain CDRs with F97H).

6. The isolated monoclonal antibody of claim 1, wherein the light chain variable domain of the antibody comprises SEQ ID NO: 238.

7. The isolated monoclonal antibody claim 6, wherein the light chain variable domain of the antibody comprises one of:
   (a) SEQ ID NO: 238, wherein $X_1$ is E; $X_2$ is I; $X_3$ is V; $X_4$ is I; $X_5$ is 5; $X_6$ is 5; $X_7$ is W; $X_8$ is D; $X_9$ is N; $X_{10}$ is T; $X_{11}$ is F; $X_{12}$ is V; $X_{13}$ is I (VRC01 light chain; SEQ ID NO: 9);
   (b) SEQ ID NO: 238, wherein $X_1$ is no amino acid; $X_2$ is no amino acid; $X_3$ is E; $X_4$ is I; $X_5$ is 5; $X_6$ is 5; $X_7$ is W; $X_8$ is D; $X_9$ is N; $X_{10}$ is T; $X_{11}$ is F; $X_{12}$ is V; and $X_{13}$ is I (VRC01L E1/I2del-V3E; SEQ ID NO: 219);
   (c) SEQ ID NO: 238, wherein $X_1$ is no amino acid; $X_2$ is no amino acid; $X_3$ is K; $X_4$ is I; $X_5$ is 5; $X_6$ is 5; $X_7$ is W; $X_8$ is D; $X_9$ is N; $X_{10}$ is T; $X_{11}$ is F; $X_{12}$ is V; and $X_{13}$ is I (VRC01L V3K light chain; SEQ ID NO: 220);
   (d) SEQ ID NO: 238, wherein $X_1$ is no amino acid; $X_2$ is no amino acid; $X_3$ is 5; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del V3S light chain; SEQ ID NO: 221);
   (e) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is D; $X_{12}$ is V; and $X_{13}$ is I (VRC01L E1/I2del F97D; SEQ ID NO: 222);
   (f) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is K; $X_{12}$ is V; and $X_{13}$ is I (VRC01L E1/I2del F97K; SEQ ID NO: 223);
   (g) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del F97S; SEQ ID NO: 224);
   (h) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del F97H; SEQ ID NO: 225);
   (i) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del V3E/F97S; SEQ ID NO: 226);
   (j) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del V3E/F97H; SEQ ID NO: 227);

(k) SEQ ID NO: 238, wherein $X_1$ is no amino acid; $X_2$ is no amino acid; $X_3$ is V; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03; SEQ ID NO: 228);

(l) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04; SEQ ID NO: 229);

(m) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05; SEQ ID NO: 230);

(n) SEQ ID NO: 238, wherein $X_1$ is no amino acid; $X_2$ is no amino acid; $X_3$ is V; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06; SEQ ID NO: 231);

(o) SEQ ID NO: 238, wherein $X_1$ is no amino acid; $X_2$ is no amino acid; $X_3$ is 5; $X_4$ is T; $X_5$ is 5; $X_6$ is 5; $X_7$ is S; $X_8$ is D; $X_9$ is T; $X_{10}$ is T; $X_{11}$ is F; $X_{12}$ is Q; and $X_{13}$ is N (VRC01hpL02 E1/I2 deletion/V3S; SEQ ID NO: 232);

(p) SEQ ID NO: 238, wherein $X_1$ is no amino acid; $X_2$ is no amino acid; $X_3$ is 5; $X_4$ is I; $X_5$ is 5; $X_6$ is 5; $X_7$ is 5; $X_8$ is D; $X_9$ is T; $X_{10}$ is T; $X_{11}$ is F; $X_{12}$ is V; and $X_{13}$ is I (VRC01hpL03 E1/I2 deletion/V3S; SEQ ID NO: 233);

(q) SEQ ID NO: 238, wherein $X_1$ is no amino acid; $X_2$ is no amino acid; $X_3$ is 5; $X_4$ is Q; $X_5$ is 5; $X_6$ is 5; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3S; SEQ ID NO: 234);

(r) SEQ ID NO: 238, wherein $X_1$ is no amino acid; $X_2$ is no amino acid; $X_3$ is 5; $X_4$ is Q; $X_5$ is 5; $X_6$ is 5; $X_7$ is N; $X_8$ is D; $X_9$ is T; $X_{10}$ is T; $X_{11}$ is F; $X_{12}$ is Q; and $X_{13}$ is N (VRC01hpL05 E1/I2 deletion/V3S; SEQ ID NO: 235);

(s) SEQ ID NO: 238, wherein $X_1$ is no amino acid; $X_2$ is no amino acid; $X_3$ is 5; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06 E1/I2 deletion/V3S; SEQ ID NO: 236);

(t) SEQ ID NO: 238, wherein $X_1$ is no amino acid; $X_2$ is no amino acid; $X_3$ is E; $X_4$ is Q; $X_5$ is 5; $X_6$ is 5; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3E; SEQ ID NO: 237);

(u) SEQ ID NO: 238, wherein $X_1$ is no amino acid; $X_2$ is no amino acid; $X_3$ is V; $X_4$ is I; $X_5$ is 5; $X_6$ is 5; $X_7$ is W; $X_8$ is D; $X_9$ is N; $X_{10}$ is T; $X_{11}$ is F; $X_{12}$ is V; and $X_{13}$ is I (VRC01 E1/I2 deletion; SEQ ID NO: 53); or (v) SEQ ID NO: 238, wherein $X_1$ is no amino acid; $X_2$ is no amino acid; $X_3$ is V; $X_4$ is T; $X_5$ is 5; $X_6$ is 5; $X_7$ is S; $X_8$ is D; $X_9$ is T; $X_{10}$ is T; $X_{11}$ is F; $X_{12}$ is Q; and $X_{13}$ is N (VRC01hpL02; SEQ ID NO: 50).

8. The isolated monoclonal antibody of claim 1, wherein the heavy chain variable domain of the antibody comprises SEQ ID NO: 40, wherein $X_1$ is I, $X_2$ is H, $X_3$ is S and $X_4$ is T (VRC07 G54H; SEQ ID NO: 32), and the light chain of the antibody comprises:

(a) SEQ ID NO: 238, wherein $X_1$ is E; $X_2$ is I; $X_3$ is V; $X_4$ is I; $X_5$ is 5; $X_6$ is 5; $X_7$ is W; $X_8$ is D; $X_9$ is N; $X_{10}$ is T; $X_{11}$ is F; $X_{12}$ is V; $X_{13}$ is I (VRC01 light chain; SEQ ID NO: 9);

(b) SEQ ID NO: 238, wherein $X_1$ is no amino acid; $X_2$ is no amino acid; $X_3$ is E; $X_4$ is I; $X_5$ is 5; $X_6$ is 5; $X_7$ is W; $X_8$ is D; $X_9$ is N; $X_{10}$ is T; $X_{11}$ is F; $X_{12}$ is V; and $X_{13}$ is I (VRC01L E1/I2del-V3E; SEQ ID NO: 219);

(c) SEQ ID NO: 238, wherein $X_1$ is no amino acid; $X_2$ is no amino acid; $X_3$ is K; $X_4$ is I; $X_5$ is 5; $X_6$ is 5; $X_7$ is W; $X_8$ is D; $X_9$ is N; $X_{10}$ is T; $X_{11}$ is F; $X_{12}$ is V; and $X_{13}$ is I (VRC01L V3K light chain; SEQ ID NO: 220);

(d) SEQ ID NO: 238, wherein $X_1$ is no amino acid; $X_2$ is no amino acid; $X_3$ is 5; $X_4$ is I; $X_5$ is 5; $X_6$ is 5; $X_7$ is W; $X_8$ is D; $X_9$ is N; $X_{10}$ is T; $X_{11}$ is F; $X_{12}$ is V; and $X_{13}$ is I (VRC01L E1/I2del V3S light chain; SEQ ID NO: 221);

(e) SEQ ID NO: 238, wherein $X_1$ is no amino acid; $X_2$ is no amino acid; $X_3$ is V; $X_4$ is I; $X_5$ is 5; $X_6$ is 5; $X_7$ is W; $X_8$ is D; $X_9$ is N; $X_{10}$ is T; $X_{11}$ is D; $X_{12}$ is V; and $X_{13}$ is I (VRC01L E1/I2del F97D; SEQ ID NO: 222);

(f) SEQ ID NO: 238, wherein $X_1$ is no amino acid; $X_2$ is no amino acid; $X_3$ is V; $X_4$ is I; $X_5$ is 5; $X_6$ is 5; $X_7$ is W; $X_8$ is D; $X_9$ is N; $X_{10}$ is T; $X_{11}$ is K; $X_{12}$ is V; and $X_{13}$ is I (VRC01L E1/I2del F97K; SEQ ID NO: 223);

(g) SEQ ID NO: 238, wherein $X_1$ is no amino acid; $X_2$ is no amino acid; $X_3$ is V; $X_4$ is I; $X_5$ is 5; $X_6$ is 5; $X_7$ is W; $X_8$ is D; $X_9$ is N; $X_{10}$ is T; $X_{11}$ is S; $X_{12}$ is V; and $X_{13}$ is I (VRC01L E1/I2del F97S; SEQ ID NO: 224);

(h) SEQ ID NO: 238, wherein $X_1$ is no amino acid; $X_2$ is no amino acid; $X_3$ is V; $X_4$ is I; $X_5$ is 5; $X_6$ is 5; $X_7$ is W; $X_8$ is D; $X_9$ is N; $X_{10}$ is T; $X_{11}$ is H; $X_{12}$ is V; and $X_{13}$ is I (VRC01L E1/I2del F97H; SEQ ID NO: 225);

(i) SEQ ID NO: 238, wherein $X_1$ is no amino acid; $X_2$ is no amino acid; $X_3$ is E; $X_4$ is I; $X_5$ is 5; $X_6$ is 5; $X_7$ is W; $X_8$ is D; $X_9$ is N; $X_{10}$ is T; $X_{11}$ is S; $X_{12}$ is V; and $X_{13}$ is I (VRC01L E1/I2del V3E/F97S; SEQ ID NO: 226);

(j) SEQ ID NO: 238, wherein $X_1$ is no amino acid; $X_2$ is no amino acid; $X_3$ is E; $X_4$ is I; $X_5$ is 5; $X_6$ is 5; $X_7$ is W; $X_8$ is D; $X_9$ is N; $X_{10}$ is T; $X_{11}$ is H; $X_{12}$ is V; and $X_{13}$ is I (VRC01L E1/I2del V3E/F97H; SEQ ID NO: 227);

(k) SEQ ID NO: 238, wherein $X_1$ is no amino acid; $X_2$ is no amino acid; $X_3$ is V; $X_4$ is I; $X_5$ is 5; $X_6$ is 5; $X_7$ is 5; $X_8$ is D; $X_9$ is T; $X_{10}$ is T; $X_{11}$ is F; $X_{12}$ is V; and $X_{13}$ is I (VRC01hpL03; SEQ ID NO: 228);

(l) SEQ ID NO: 238, wherein $X_1$ is no amino acid; $X_2$ is no amino acid; $X_3$ is V; $X_4$ is Q; $X_5$ is 5; $X_6$ is 5; $X_7$ is N; $X_8$ is D; $X_9$ is T; $X_{10}$ is T; $X_{11}$ is F; $X_{12}$ is V; and $X_{13}$ is I (VRC01hpL04; SEQ ID NO: 229);

(m) SEQ ID NO: 238, wherein $X_1$ is no amino acid; $X_2$ is no amino acid; $X_3$ is V; $X_4$ is Q; $X_5$ is 5; $X_6$ is 5; $X_7$ is N; $X_8$ is D; $X_9$ is T; $X_{10}$ is T; $X_{11}$ is F; $X_{12}$ is Q; and $X_{13}$ is N (VRC01hpL05; SEQ ID NO: 230);

(n) SEQ ID NO: 238, wherein $X_1$ is no amino acid; $X_2$ is no amino acid; $X_3$ is V; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06; SEQ ID NO: 231);

(o) SEQ ID NO: 238, wherein $X_1$ is no amino acid; $X_2$ is no amino acid; $X_3$ is 5; $X_4$ is T; $X_5$ is 5; $X_6$ is 5; $X_7$ is S; $X_8$ is D; $X_9$ is T; $X_{10}$ is T; $X_{11}$ is F; $X_{12}$ is Q; and $X_{13}$ is N (VRC01hpL02 E1/I2 deletion/V3S; SEQ ID NO: 232);

(p) SEQ ID NO: 238, wherein $X_1$ is no amino acid; $X_2$ is no amino acid; $X_3$ is 5; $X_4$ is I; $X_5$ is 5; $X_6$ is 5; $X_7$ is 5; $X_8$ is D; $X_9$ is T; $X_{10}$ is T; $X_{11}$ is F; $X_{12}$ is V; and $X_{13}$ is I (VRC01hpL03 E1/I2 deletion/V3S; SEQ ID NO: 233);

(q) SEQ ID NO: 238, wherein $X_1$ is no amino acid; $X_2$ is no amino acid; $X_3$ is 5; $X_4$ is Q; $X_5$ is 5; $X_6$ is 5; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3S; SEQ ID NO: 234);

(r) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05 E1/I2 deletion/V3S; SEQ ID NO: 235);

(s) SEQ ID NO: 238, wherein $X_1$ is no amino acid; $X_2$ is no amino acid; $X_3$ is S; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06 E1/I2 deletion/V3S; SEQ ID NO: 236);

(t) SEQ ID NO: 238, wherein $X_1$ is no amino acid; $X_2$ is no amino acid; $X_3$ is E; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3E; SEQ ID NO: 237);

(u) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01 E1/I2 deletion; SEQ ID NO: 53); or (v) SEQ ID NO: 238, wherein $X_1$ is no amino acid; $X_2$ is no amino acid; $X_3$ is V; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02; SEQ ID NO: 50).

9. The isolated monoclonal antibody of claim 1, wherein the heavy chain variable domain of the antibody comprises SEQ ID NO: 40, wherein $X_1$ is V, $X_2$ is H, $X_3$ is S and $X_4$ is A (VRC07 I37V, G54H, T93A; SEQ ID NO: 259), and the light chain of the antibody comprises:

(a) SEQ ID NO: 238, wherein $X_1$ is E; $X_2$ is I; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; $X_{13}$ is I (VRC01 light chain; SEQ ID NO: 9);

(b) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del-V3E; SEQ ID NO: 219);

(c) SEQ ID NO: 238, wherein $X_1$ is no amino acid; $X_2$ is no amino acid; $X_3$ is K; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L V3K light chain; SEQ ID NO: 220);

(d) SEQ ID NO: 238, wherein $X_1$ is no amino acid; $X_2$ is no amino acid; $X_3$ is S; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01L E1/I2del V3S light chain; SEQ ID NO: 221);

(e) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is D; $X_{12}$ is V; and $X_{13}$ is I (VRC01L E1/I2del F97D; SEQ ID NO: 222);

(f) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is K; $X_{12}$ is V; and $X_{13}$ is I (VRC01L E1/I2del F97K; SEQ ID NO: 223);

(g) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del F97S; SEQ ID NO: 224);

(h) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del F97H; SEQ ID NO: 225);

(i) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is S; $X_{12}$ is V; and $X_{13}$ is I (VRC01L E1/I2del V3E/F97S; SEQ ID NO: 226);

(j) SEQ ID NO: 238, wherein $X_1$ is no amino acid; $X_2$ is no amino acid; $X_3$ is E; $X_4$ is I; $X_5$ is S; $X_6$ is S; $X_7$ is W; $X_8$ is D; $X_9$ is N; $X_{10}$ is T; $X_{11}$ is H; $X_{12}$ is V; and $X_{13}$ is I (VRC01L E1/I2del V3E/F97H; SEQ ID NO: 227);

(k) SEQ ID NO: 238, wherein $X_1$ is no amino acid; $X_2$ is no amino acid; $X_3$ is V; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03; SEQ ID NO: 228);

(l) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04; SEQ ID NO: 229);

(m) SEQ ID NO: 238, wherein $X_1$ is no amino acid; $X_2$ is no amino acid; $X_3$ is V; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05; SEQ ID NO: 230);

(n) SEQ ID NO: 238, wherein $X_1$ is no amino acid; $X_2$ is no amino acid; $X_3$ is V; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06; SEQ ID NO: 231);

(o) SEQ ID NO: 238, wherein $X_1$ is no amino acid; $X_2$ is no amino acid; $X_3$ is S; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02 E1/I2 deletion/V3S; SEQ ID NO: 232);

(p) SEQ ID NO: 238, wherein $X_1$ is no amino acid; $X_2$ is no amino acid; $X_3$ is S; $X_4$ is I; $X_5$ is S; $X_6$ is S; $X_7$ is S; $X_8$ is D; $X_9$ is T; $X_{10}$ is T; $X_{11}$ is F; $X_{12}$ is V; and $X_{13}$ is I (VRC01hpL03 E1/I2 deletion/V3S; SEQ ID NO: 233);

(q) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3S; SEQ ID NO: 234);

(r) SEQ ID NO: 238, wherein $X_1$ is no amino acid; $X_2$ is no amino acid; $X_3$ is S; $X_4$ is Q; $X_5$ is S; $X_6$ is S; $X_7$ is N; $X_8$ is D; $X_9$ is T; $X_{10}$ is T; $X_{11}$ is F; $X_{12}$ is Q; and $X_{13}$ is N (VRC01hpL05 E1/I2 deletion/V3S; SEQ ID NO: 235);

(s) SEQ ID NO: 238, wherein $X_1$ is no amino acid; $X_2$ is no amino acid; $X_3$ is S; $X_4$ is E; $X_5$ is K; $X_6$ is E; $X_7$ is E; $X_8$ is E; $X_9$ is R; $X_{10}$ is R; $X_{11}$ is F; $X_{12}$ is Q; and $X_{13}$ is N (VRC01hpL06 E1/I2 deletion/V3S; SEQ ID NO: 236);

(t) SEQ ID NO: 238, wherein $X_1$ is no amino acid; $X_2$ is no amino acid; $X_3$ is E; $X_4$ is Q; $X_5$ is S; $X_6$ is S; $X_7$ is N; $X_8$ is D; $X_9$ is T; $X_{10}$ is T; $X_{11}$ is F; $X_{12}$ is V; and $X_{13}$ is I (VRC01hpL04 E1/I2 deletion/V3E; SEQ ID NO: 237);

(u) SEQ ID NO: 238, wherein $X_1$ is no amino acid; $X_2$ is no amino acid; $X_3$ is V; $X_4$ is I; $X_5$ is S; $X_6$ is S; $X_7$ is W; $X_8$ is D; $X_9$ is N; $X_{10}$ is T; $X_{11}$ is F; $X_{12}$ is V; and $X_{13}$ is I (VRC01 E1/I2 deletion; SEQ ID NO: 53); or (v) SEQ ID NO: 238, wherein $X_1$ is no amino acid; $X_2$ is no amino acid; $X_3$ is V; $X_4$ is T; $X_5$ is S; $X_6$ is S; $X_7$ is S; $X_8$ is D; $X_9$ is T; $X_{10}$ is T; $X_{11}$ is F; $X_{12}$ is Q; and $X_{13}$ is N (VRC01hpL02; SEQ ID NO: 50).

10. The isolated monoclonal antibody of claim 1, wherein the antibody is not self-reactive.

11. The isolated monoclonal antibody of claim 1, wherein the antibody is an IgG, IgM or IgA.

12. An isolated antigen binding fragment of the antibody of claim 1.

13. The isolated antigen binding fragment of claim 12, wherein the antigen binding fragment is a Fab fragment, a Fab' fragment, a F(ab)'$_2$ fragment, a single chain Fv protein (scFv) fragment, or a disulfide stabilized Fv protein (dsFv).

14. The isolated monoclonal antibody of claim 1, linked to an effector moiety.

15. The isolated monoclonal antibody of claim 14, wherein the effector moiety is a toxin or a detectable label.

16. The isolated monoclonal antibody of claim 15, wherein the detectable label is a fluorescent, enzymatic, or radioactive label.

17. A composition comprising a therapeutically effective amount of the antibody of claim 1.

18. A method of detecting a human immunodeficiency virus type 1 (HIV-1) infection in a subject, comprising:
   contacting a biological sample from the subject with the isolated monoclonal antibody of claim 1 under conditions sufficient to form an immune complex with HIV-1 Env; and
   detecting the presence of the immune complex in the sample from the subject, wherein the presence of the immune complex on the sample from the subject indicates that the subject has an HIV-1 infection.

19. The method of claim 18, wherein the isolated monoclonal antibody is directly labeled.

20. The method of claim 18, further comprising:
   contacting the sample with a second antibody that specifically binds the isolated monoclonal antibody or antigen binding fragment; and
   detecting the binding of the second antibody to the sample;
   wherein an increase in binding of the second antibody to the sample as compared to binding of the second antibody to a control sample detects the presence of an HIV-1 infection the subject.

21. A method for inhibiting human immunodeficiency virus type 1 (HIV-1) replication in a subject, comprising administering to the subject a therapeutically effective amount of the antibody of claim 1, thereby inhibiting HIV-1 replication in the subject.

22. The method of claim 21, further comprising administering to the subject one or more additional antibodies, wherein the additional antibodies specifically bind gp120 and/or gp41.

23. The method of claim 21, further comprising measuring HIV-1 viral titer in the subject.

24. A kit comprising:
   (a) a container comprising the antibody of claim 1; and
   (b) instructions for using the kit.

25. An isolated antibody, comprising:
   a heavy chain variable domain comprising a heavy chain complementary determining region (HCDR)1, a HCDR2, and HCDR3 comprising amino acids 26-33, 51-58, and 97-114 of SEQ ID NO: 32, respectively; and
   a light chain variable domain comprising a light chain complementary determining region (LCDR)1, a LCDR2, and a LCDR3 comprising amino acids 25-28, 46-48, and 85-89 of SEQ NO: 221, respectively,
   wherein the antibody specifically binds a CD4 binding site on human immunodeficiency virus type 1 (HIV-1) gp120 and neutralizes HIV-1.

26. The isolated antibody of claim 25, wherein the heavy chain variable domain comprises the amino acid sequence set forth as SEQ ID NO: 32, and the light chain variable domain comprises the amino acid sequence set forth as SEQ NO: 221.

27. The isolated monoclonal antibody of claim 25, wherein the antibody is an IgG.

28. An isolated antigen binding fragment of the antibody of claim 25.

29. The isolated antigen binding fragment of claim 28, wherein the antigen binding fragment is a Fab fragment, a Fab' fragment, a F(ab)'$_2$ fragment, a single chain Fv protein (scFv) fragment, or a disulfide stabilized Fv protein (dsFv).

30. The isolated monoclonal antibody of claim 25 or an antigen binding fragment thereof, linked to an effector moiety.

31. The isolated monoclonal antibody of claim 30, wherein the effector moiety is a toxin or a detectable label.

32. A pharmaceutical composition comprising the isolated antibody of claim 25.

33. A method for inhibiting human immunodeficiency virus type 1 (HIV-1) replication in a subject, comprising administering to the subject a therapeutically effective amount of the isolated antibody of claim 25, thereby inhibiting HIV-1 replication in the subject.

34. An isolated antibody, comprising:
   a heavy chain variable domain comprising the amino acid sequence set forth as SEQ ID NO: 259; and
   a light chain variable domain comprises the amino acid sequence set forth as SEQ NO: 221.

35. The isolated monoclonal antibody of claim 34, wherein the antibody is an IgG.

36. An isolated antigen binding fragment of the antibody of claim 34.

37. The isolated antigen binding fragment of claim 36, wherein the antigen binding fragment is a Fab fragment, a Fab' fragment, a F(ab)'$_2$ fragment, a single chain Fv protein (scFv) fragment, or a disulfide stabilized Fv protein (dsFv).

38. The isolated monoclonal antibody of claim 34 or an antigen binding fragment thereof, linked to an effector moiety.

39. The isolated monoclonal antibody of claim 38, wherein the effector moiety is a toxin or a detectable label.

40. A pharmaceutical composition comprising the isolated antibody of claim 34.

41. A method for inhibiting human immunodeficiency virus type 1 (HIV-1) replication in a subject, comprising administering to the subject a therapeutically effective amount of the isolated antibody of claim 34, thereby inhibiting HIV-1 replication in the subject.

* * * * *